United States Patent 11,446,398 (REGULATED BIOCIRCUIT SYSTEMS) - sequence listing, part 6

SEQ ID NO: 20296 - protein, 197 aa, Homo sapiens
  Payload ID: 4055
  Gene Symbol: CRYZL1
  Gene Name: crystallin, zeta (quinone reductase)-like 1
  ENSP ID: ENSP00000399730
MKGLYFQQSSTDEEITFVFQEKEDLPVTEDNFVKLQVKACALSQINTKLLAEMKMKKDLFPVGREIAGIVLDVHKPEKVTWTEAAGSIRDGVRAYTALHYLSHLSPGKSVLIMDGASAFGTIAIQLAHHRGAKVISTACSLEDKQCLERFRPPIDLSWMNPFHCMRQKFPWKLFRKIKEEKSKLFNFNFLLSQTSVG

SEQ ID NO: 20297 - protein, 183 aa, Homo sapiens
  Payload ID: 4055
  Gene Symbol: CRYZL1
  Gene Name: crystallin, zeta (quinone reductase)-like 1
  ENSP ID: ENSP00000399937
MKGLYFQQSSTDEEITFVFQEKEDLPVTEDNFVKLQVKACALSQINTKLLAEMKMKKDLFPVGREIAGIVLDGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 20298 - protein, 107 aa, Homo sapiens
  Payload ID: 4055
  Gene Symbol: CRYZL1
  Gene Name: crystallin, zeta (quinone reductase)-like 1
  ENSP ID: ENSP00000402844
MKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGT

SEQ ID NO: 20299 - protein, 181 aa, Homo sapiens
  Payload ID: 4055
  Gene Symbol: CRYZL1
  Gene Name: crystallin, zeta (quinone reductase)-like 1
  ENSP ID: ENSP00000405510
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLED

SEQ ID NO: 20300 - protein, 17 aa, Homo sapiens
  Payload ID: 4055
  Gene Symbol: CRYZL1
  Gene Name: crystallin, zeta (quinone reductase)-like 1
  ENSP ID: ENSP00000406423
  MOD_RES (1)..(1): Any amino acid
XQCLERFRPPIENSTIA

SEQ ID NO: 20301 - protein, 19 aa, Homo sapiens
  Payload ID: 4055
  Gene Symbol: CRYZL1
  Gene Name: crystallin, zeta (quinone reductase)-like 1
  ENSP ID: ENSP00000408385
MKGLYFQQSSTDEEITFVF

SEQ ID NO: 20302 - protein, 97 aa, Homo sapiens
  Payload ID: 4055
  Gene Symbol: CRYZL1
  Gene Name: crystallin, zeta (quinone reductase)-like 1
  ENSP ID: ENSP00000409387
HLSPGKSVLIMDGASAFGTIAIQLAHHRGAKVISTACSLEDKQCLERFRPPIARVIDVSNGKVHVAESCLEETGGLGVDIVLDAGGYIFQHSSYIFT

SEQ ID NO: 20303 - protein, 241 aa, Homo sapiens
  Payload ID: 4055
  Gene Symbol: CRYZL1
  Gene Name: crystallin, zeta (quinone reductase)-like 1
  ENSP ID: ENSP00000412087
  MOD_RES (1)..(1): Any amino acid
XDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQVKKQKHRDVDTDSRTQQVAEQESHSGSLSPF

SEQ ID NO: 20304 - protein, 96 aa, Homo sapiens
  Payload ID: 4055
  Gene Symbol: CRYZL1
  Gene Name: crystallin, zeta (quinone reductase)-like 1
  ENSP ID: ENSP00000413513
  MOD_RES (1)..(1): Any amino acid
XRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 20305 - protein, 198 aa, Homo sapiens
  Payload ID: 4055
  Gene Symbol: CRYZL1
  Gene Name: crystallin, zeta (quinone reductase)-like 1
  Uniprot ID: O95825
  ENSP ID: ENSP00000416315
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIENSTIA

SEQ ID NO: 20306 - protein, 971 aa, Homo sapiens
  Payload ID: 4056
  Gene Symbol: CSE1L
  Gene Name: CSE1 chromosome segregation 1-like (yeast)
  Uniprot ID: P55060
  ENSP ID: ENSP00000262982
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 20307 - protein, 915 aa, Homo sapiens
  Payload ID: 4056
  Gene Symbol: CSE1L
  Gene Name: CSE1 chromosome segregation 1-like (yeast)
  Uniprot ID: P55060
  ENSP ID: ENSP00000379495
MELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 20308 - protein, 450 aa, Homo sapiens
  Payload ID: 4057
  Gene Symbol: CSK
  Gene Name: c-src tyrosine kinase
  Uniprot ID: P41240
  ENSP ID: ENSP00000220003
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 20309 - protein, 450 aa, Homo sapiens; identical to SEQ ID NO: 20308
  Payload ID: 4057
  Gene Symbol: CSK
  Gene Name: c-src tyrosine kinase
  Uniprot ID: P41240
  ENSP ID: ENSP00000414764

SEQ ID NO: 20310 - protein, 64 aa, Homo sapiens
  Payload ID: 4057
  Gene Symbol: CSK
  Gene Name: c-src tyrosine kinase
  ENSP ID: ENSP00000454640
MSAIQAAWPSGTECIAKYNFHGTAEQDLPFCKGDVLTIVAVTKDPNWYKAKNKVGREGIIPANY

SEQ ID NO: 20311 - protein, 450 aa, Homo sapiens; identical to SEQ ID NO: 20308
  Payload ID: 4057
  Gene Symbol: CSK
  Gene Name: c-src tyrosine kinase
  Uniprot ID: P41240
  ENSP ID: ENSP00000454906

SEQ ID NO: 20312 - protein, 68 aa, Homo sapiens
  Payload ID: 4057
  Gene Symbol: CSK
  Gene Name: c-src tyrosine kinase
  ENSP ID: ENSP00000457497
MPWFHGKITREQAERLLYPPETGLFLVRESTNYPGDYTLCVSCDGKVEHYRIMYHASKLSIDEEVYFE

SEQ ID NO: 20313 - protein, 110 aa, Homo sapiens
  Payload ID: 4057
  Gene Symbol: CSK
  Gene Name: c-src tyrosine kinase
  ENSP ID: ENSP00000457714
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVREST

SEQ ID NO: 20314 - protein, 781 aa, Homo sapiens
  Payload ID: 4058
  Gene Symbol: CSRP2BP
  Gene Name: CSRP2 binding protein
  ENSP ID: ENSP00000366909
MDSSIHLSSLISRHDDEATRTSTSEGLEEGEVEGETLLIVESEDQASVDLSHDQSGDSLNSDEGDVSWMEEQLSYFCDKCQKWIPASQLREQLSYLKGDNFFRFTCSDCSADGKEQYERLKLTWQQVVMLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGVRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 20315 - protein, 782 aa, Homo sapiens
  Payload ID: 4058
  Gene Symbol: CSRP2BP
  Gene Name: CSRP2 binding protein
  Uniprot ID: Q9H8E8
  ENSP ID: ENSP00000392318
MDSSIHLSSLISRHDDEATRTSTSEGLEEGEVEGETLLIVESEDQASVDLSHDQSGDSLNSDEGDVSWMEEQLSYFCDKCQKWIPASQLREQLSYLKGDNFFRFTCSDCSADGKEQYERLKLTWQQVVMLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKAASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGVRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 20316 - protein, 56 aa, Homo sapiens
  Payload ID: 4058
  Gene Symbol: CSRP2BP
  Gene Name: CSRP2 binding protein
  ENSP ID: ENSP00000424752
MDSSIHLSSLISRHDDEATRTSTSEGLEEGEVEGETLLIVESEDQASVDLSHDQSG

SEQ ID NO: 20317 - protein, 654 aa, Homo sapiens
  Payload ID: 4058
  Gene Symbol: CSRP2BP
  Gene Name: CSRP2 binding protein
  Uniprot ID: Q9H8E8
  ENSP ID: ENSP00000425909
MLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKAASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGVRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 20318 - protein, 777 aa, Homo sapiens
  Payload ID: 4059
  Gene Symbol: CTAGE15
  Gene Name: CTAGE family, member 15
  Uniprot ID: A4D2H0
  ENSP ID: ENSP00000474204
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 20319 - protein, 777 aa, Homo sapiens
  Payload ID: 4060
  Gene Symbol: CTAGE4
  Gene Name: CTAGE family, member 4
  Uniprot ID: Q8IX94
  ENSP ID: ENSP00000419539
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 20320 - protein, 804 aa, Homo sapiens
  Payload ID: 4061
  Gene Symbol: CTAGE5
  Gene Name: CTAGE family, member 5
  Uniprot ID: O15320
  ENSP ID: ENSP00000280083
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20321 - protein, 771 aa, Homo sapiens
  Payload ID: 4061
  Gene Symbol: CTAGE5
  Gene Name: CTAGE family, member 5
  Uniprot ID: O15320
  ENSP ID: ENSP00000339286
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFASARSPPGAGAPASGRGLGGPQK

SEQ ID NO: 20322 - protein, 792 aa, Homo sapiens
  Payload ID: 4061
  Gene Symbol: CTAGE5
  Gene Name: CTAGE family, member 5
  Uniprot ID: O15320
  ENSP ID: ENSP00000343897
MELKSPEEEVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20323 - protein, 761 aa, Homo sapiens
  Payload ID: 4061
  Gene Symbol: CTAGE5
  Gene Name: CTAGE family, member 5
  Uniprot ID: O15320
  ENSP ID: ENSP00000343912
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20324 - protein, 809 aa, Homo sapiens
  Payload ID: 4061
  Gene Symbol: CTAGE5
  Gene Name: CTAGE family, member 5
  Uniprot ID: O15320
  ENSP ID: ENSP00000379462
MEEPGVTPQPYLGLLLEELRRVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEVENQMATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20325 - protein, 775 aa, Homo sapiens
  Payload ID: 4061
  Gene Symbol: CTAGE5
  Gene Name: CTAGE family, member 5
  Uniprot ID: O15320
  ENSP ID: ENSP00000379468
MRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20326 - protein, 775 aa, Homo sapiens; identical to SEQ ID NO: 20325
  Payload ID: 4061
  Gene Symbol: CTAGE5
  Gene Name: CTAGE family, member 5
  Uniprot ID: O15320
  ENSP ID: ENSP00000450449

SEQ ID NO: 20327 - protein, 724 aa, Homo sapiens
  Payload ID: 4061
  Gene Symbol: CTAGE5
  Gene Name: CTAGE family, member 5
  Uniprot ID: O15320
  ENSP ID: ENSP00000450869
MLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20328 - protein, 138 aa, Homo sapiens
  Payload ID: 4061
  Gene Symbol: CTAGE5
  Gene Name: CTAGE family, member 5
  ENSP ID: ENSP00000451164
MELKSPEEEVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEFVEGSQISEATCEKLNRSNSEL

SEQ ID NO: 20329 - protein, 151 aa, Homo sapiens
  Payload ID: 4061
  Gene Symbol: CTAGE5
  Gene Name: CTAGE family, member 5
  ENSP ID: ENSP00000452395
MELKSPEEEVVAALPEGMRPDSNLYGFPWELVICAAVVGFFAVLFFLWRSFRSVRSRLYVGREKKLALMLSGLIEEKSKLLEKFSLVQKEATCEKLNRSNSELEDEILCLEKELKEEKSKHSEQDELMADISKRIQSLEDESKSLKSQVAE

SEQ ID NO: 20330 - protein, 729 aa, Homo sapiens
  Payload ID: 4061
  Gene Symbol: CTAGE5
  Gene Name: CTAGE family, member 5
  Uniprot ID: O15320
  ENSP ID: ENSP00000452562
MLSGLIEEKSKLLEKFSLVQKEYEGYEVESSLKDASFEKEATEAQSLEVENQMATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 20331 - protein, 777 aa, Homo sapiens
  Payload ID: 4062
  Gene Symbol: CTAGE6
  Gene Name: CTAGE family, member 6
  Uniprot ID: Q86UF2
  ENSP ID: ENSP00000474388
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQESLQSENIYFESENQKLQQKLKIMTEFYQEDEMKLYRKLTVEENYRIEEEEKLSKVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 20332 - protein, 777 aa, Homo sapiens
  Payload ID: 4063
  Gene Symbol: CTAGE8
  Gene Name: CTAGE family, member 8
  Uniprot ID: P0CG41
  ENSP ID: ENSP00000417289
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYLHPRPGFYPNPTF

SEQ ID NO: 20333 - protein, 777 aa, Homo sapiens
  Payload ID: 4064
  Gene Symbol: CTAGE9
  Gene Name: CTAGE family, member 9
  Uniprot ID: A4FU28
  ENSP ID: ENSP00000395587
MEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELKVNSQWENGANLDDPPKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISHATEELETYRKLAKDLEEELERTVHFYQKQVISYEKRGHDNWLAARTAERNLSDLRKENAHNKQKLTERELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 20334 - protein, 139 aa, Homo sapiens
  Payload ID: 4065
  Gene Symbol:
  Gene Name: CTB-102L5.4
  ENSP ID: ENSP00000465845
  MOD_RES (1)..(1): Any amino acid
XILKTTPAICSTMKNTAPPTQSLGLAVHPSHAGTLTWRGTPAITSSMEAAGAIRTATALRRPACSAASASRRILPCPLAQRPWSPPPRSPVWGRATGEIPSSVPTKFRAGRRQGQVRVQSKDTTALPTPAAAPAIRTRM

SEQ ID NO: 20335 - protein, 153 aa, Homo sapiens
  Payload ID: 4065
  Gene Symbol:
  Gene Name: CTB-102L5.4
  ENSP ID: ENSP00000468040
  MOD_RES (1)..(1): Any amino acid
XSDMFNYEEYCTANAVTGPCRASFPRWYFDVERNSCNNFIYGGCRGNKNSYRSEEACMLRCFRQQENPPLPLGSKALEPTSQKPGVGAGHGGDPKLSPHKVQGRSEAGAGPGPKASNFRGLGKGRRLTAAPPSSKDTTALPTPAAAPAIRTRM

SEQ ID NO: 20336 - protein, 382 aa, Homo sapiens
  Payload ID: 4066
  Gene Symbol:
  Gene Name: CTB-133G6.1
  Uniprot ID: I3L1I5
  ENSP ID: ENSP00000458866
MGDDQEDDFPRRLSESMEDLSLDLGALQGSEYLQDLGLGAPSHSQPGETPDSRPTGEEPGRDSLFSSLAGSQDLSRRRSWERSRSCSESWRRLSLDASAVDEEPCLPRTLASLALNLPGGGLKTWTQGCLSGGGTPAESPGKECDSPKKRGRSRSVPVSFYEIRSPEISPGLEVPTPPVQGLEPPVLECMEKDHVEPDHVLIVQQVLQELRQYHGARQRACMSASPGGAHSNLTWFEFLSESEDGAGKNEKSDKSTSVKRRLSCLRSRVTRQKEKGKSPAHLKDKGQDARERRECVNGHQLLQGTFSGPSSCPLCGKPFLSSGKSGGPIHPPGGQPLSLLHVLSIILLGSLLMCASSFCFALSSAAPWREPGISPWAQGPLG

SEQ ID NO: 20337 - protein, 84 aa, Homo sapiens
  Payload ID: 4067
  Gene Symbol:
  Gene Name: CTB-50L17.14
  ENSP ID: ENSP00000464793
MSSWSRQRPKRVTLFAARCLKKRRLRSPDPVCGSRTSRTWCSVWWLCPWSGPRAPRSAMFTVQPRTGTRCWAPPAAWLRTACAA

SEQ ID NO: 20338 - protein, 77 aa, Homo sapiens
  Payload ID: 4068
  Gene Symbol:
  Gene Name: CTB-54O9.9
  ENSP ID: ENSP00000466514
LSFLCRYVPVGLLERLPQRINERPPYYLGRDYLETLMASQKAADWIRIRLLEPVSSPRPRERGVSSPTSRYRPPLSP

SEQ ID NO: 20339 - protein, 129 aa, Homo sapiens; identical to SEQ ID NO: 15150
  Payload ID: 4069
  Gene Symbol:
  Gene Name: CTB-60B18.6
  ENSP ID: ENSP00000466140

SEQ ID NO: 20340 - protein, 77 aa, Homo sapiens
  Payload ID: 4069
  Gene Symbol:
  Gene Name: CTB-60B18.6
  ENSP ID: ENSP00000474022
MSKGLLLLLLLSMGGTWASKEPLRPRCRPINATLAVEKEGCPVCITVNTTICAGYCPTMTRVLQGVLPALPQVVCNY

SEQ ID NO: 20341 - protein, 148 aa, Homo sapiens
  Payload ID: 4070
  Gene Symbol:
  Gene Name: CTB-96E2.2
  ENSP ID: ENSP00000452347
PGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRWQRVGFPPEKADHLQQRAATGAGEGVCSMALPQHQHP

SEQ ID NO: 20342 - protein, 273 aa, Homo sapiens
  Payload ID: 4071
  Gene Symbol:
  Gene Name: CTC-260F20.3
  ENSP ID: ENSP00000452549
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGMPGRGGHIGAWGAWVEAPVPQLLVAPACLNLNLPSLDGPTLG

SEQ ID NO: 20343 - protein, 97 aa, Homo sapiens
  Payload ID: 4072
  Gene Symbol:
  Gene Name: CTC-273B12.7
  ENSP ID: ENSP00000470383
MELENIRRRKQELLVEIQRLREELSEAMSEVEGLEANEGSKTLQRNRKMAMGRKKFNMDPKKGIQFLVENELLQNTPEEIARFLYKGEGLNKTAIGD

SEQ ID NO: 20344 - protein, 1178 aa, Homo sapiens
  Payload ID: 4073
  Gene Symbol:
  Gene Name: CTC-281F24.5
  ENSP ID: ENSP00000488967
MSRETRRGALPRLRRGEQAAKMPGRCVGPSRSGRGVRRPWGKRRGAGTSRGRGARRRAKPSEWETRCVSAERPQGRQRPWGTRQAAETADAAGANEALGAPGTPGSIEAARDPGAVWVNGAVGEPEVVGLAGAVWVTGSGEEETEDRSPRGCERKGRPGSLGHESILHLWLKVQAMRAASGCGEGSRVELHPVPAGEGPVERGVPGRASWVETSRGGLTGPWVKEQARGIPRAPSGPTALGLGAAYERALGFCGQGQAGRVPPASVPGALASSSEMAPHLWRGEAVGVPETGEEIGYGFVSGPCEKEQTMGEPGTVGWTGAVGAPRAMEGELGCGGAAGLWGRGQSPQIPGALTHEAVCGATPGVWGRGQAVGVSDAVEEEPTSVGAAGVCYRRQAVEETDSVGMPGPWGTGYSVGVPCAAEEETRCGGDPGFRERGQPVWVETGSGGDPGSRGAAQTAESSCPGEQAAGSGGAPGLWGIQQATGVPRALGKDTGCVSVPGLWGAGQMVRVPQAVVVPGALGEELSHSGGLGLWDGQQALGGPPAEAVPGLGEETCSGNVLSPWERRQAVGEPESLGPPALGVPGSVDQEAGCGDVACQCGRRQAVGVSETVGIPRAADVPRQGCAAAGVLMAMGVPGSGKVPARVPAAVWASGPVCQEGSSRDILNLWERTRAARISVASGGPVAREELWSGGEESVASGGPVAQEELWSGGEESVASGGHVAREKLWSGGEDCGSGAFPGPWGRRQTIGVPVVPEGPGLGGETDSGGIPRPWGQRQRVRAPVATEVLLAPRVPGSVELEPGDGGFSGLSGRQQTAGMPGTVGLSAASGVPVAPRVPRPVQEETGSELWGERETVGGPADAKGPTRMEVPTSTRMPGPMAEKTGSGGVSGLLGGRQTTGVSMAVGLLGSVGEGTIFEHVSGLSGRRQTAGRPVAARGSMAVGVPTAPGLPGPMVGDTGSGDDGSGIWGRRLATEGPTAARVPGPVEGETGSEGVSGLWRRRHGGAIPEAGRVPLPLGVLAAVGAPMAGRAPAAVWVTGSSGAEADVGVSGLTVLRRQSTGGVGASEDETGGGNILGLAGGSQAVGTSHTCVPGARLWSCPRSLGEETAYENALGMSGTRTAVGVPSVSREEIGLGHFRDHLQPSGRRLAGGVSAVRVRGSNLGESYVGEARLRGAFQ

SEQ ID NO: 20345 - protein, 37 aa, Homo sapiens
  Payload ID: 4074
  Gene Symbol:
  Gene Name: CTC-326K19.6
  ENSP ID: ENSP00000391489
NSSLSLHGGLSSGLRLRCKAWNVHGAQSGSVFQLLPG

SEQ ID NO: 20346 - protein, 588 aa, Homo sapiens
  Payload ID: 4075
  Gene Symbol:
  Gene Name: CTC-360G5.8
  ENSP ID: ENSP00000472465
  MOD_RES (1)..(1): Any amino acid
XGGGAEGRSAWAVGPVGGAGEEGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 20347 - protein, 588 aa, Homo sapiens; identical to SEQ ID NO: 20346
  Payload ID: 4075
  Gene Symbol:
  Gene Name: CTC-360G5.8
  ENSP ID: ENSP00000488961
  MOD_RES (1)..(1): Any amino acid

SEQ ID NO: 20348 - protein, 188 aa, Homo sapiens
  Payload ID: 4076
  Gene Symbol:
  Gene Name: CTC-398G3.6
  ENSP ID: ENSP00000466387
  MOD_RES (1)..(1): Any amino acid
XRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKADTGGHGVSGGGGPGRPGPAQRATPWYKWSH

SEQ ID NO: 20349 - protein, 62 aa, Homo sapiens
  Payload ID: 4077
  Gene Symbol:
  Gene Name: CTC-429P9.4
  ENSP ID: ENSP00000470086
GDILLFGTLLMNAGAVLNFKLKKKDTQGFGEESREPSTDPEHGGGAGSHLQPGEIPYYQRGT

SEQ ID NO: 20350 - protein, 49 aa, Homo sapiens
  Payload ID: 4077
  Gene Symbol:
  Gene Name: CTC-429P9.4
  ENSP ID: ENSP00000470469
MIGDILLFGTLLMNAGAVLNFKLKKKDTQGFGEESREPSTGCSALESQR

SEQ ID NO: 20351 - protein, 73 aa, Homo sapiens
  Payload ID: 4077
  Gene Symbol:
  Gene Name: CTC-429P9.4
  ENSP ID: ENSP00000471649
GDILLFGTLLMNAGAVLNFKLKKKDTQGFGEESREPSTGDNIREFLLSLRYFRIFIALWNIFMMFCMIVLFGS

SEQ ID NO: 20352 - protein, 73 aa, Homo sapiens; identical to SEQ ID NO: 20351
  Payload ID: 4077
  Gene Symbol:
  Gene Name: CTC-429P9.4
  ENSP ID: ENSP00000472547

SEQ ID NO: 20353 - protein, 63 aa, Homo sapiens
  Payload ID: 4077
  Gene Symbol:
  Gene Name: CTC-429P9.4
  ENSP ID: ENSP00000472751
MNAGAVLNFKLKKKDTQGFGEESREPSTGDNIREFLLSLRYFRIFIALWNIFMMFCMIVLFGS

SEQ ID NO: 20354 - protein, 49 aa, Homo sapiens; identical to SEQ ID NO: 20350
  Payload ID: 4077
  Gene Symbol:
  Gene Name: CTC-429P9.4
  ENSP ID: ENSP00000472877

SEQ ID NO: 20355 - protein, 1651 aa, Homo sapiens
  Payload ID: 4078
  Gene Symbol:
  Gene Name: CTC-432M15.3
  ENSP ID: ENSP00000426948
MAPTLFQKLFSKRTGLGAPGRDARDPDCGFSWPLPEFDPSQIRLIVYQDCERRGRNVLFDSSVKRRNEDISVSDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 20356 - protein, 479 aa, Homo sapiens
  Payload ID: 4079
  Gene Symbol:
  Gene Name: CTC-435M10.3
  ENSP ID: ENSP00000443246
MDSPSLRELQQPLLEGTECETPAQKPGRHELGSPLREIAFAESLRGLQFLSPPLPSVSAGLGEPRPPDVEHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 20357 - protein, 120 aa, Homo sapiens
  Payload ID: 4080
  Gene Symbol:
  Gene Name: CTC-454I21.3
  ENSP ID: ENSP00000465212
  MOD_RES (1)..(1): Any amino acid
XLAPEDHGSSYEGSVSFRDVAIDFSREEWRHLDPSQRNLYRDVMLETYSHLLSVGYQVPEAEVVMLEQGKEPWALQGERPRQSCPVTHRLPLPSTMTKSFLDLTRSQADTSAMLVQPPEA

SEQ ID NO: 20358 - protein, 148 aa, Homo sapiens
  Payload ID: 4080
  Gene Symbol:
  Gene Name: CTC-454I21.3
  ENSP ID: ENSP00000465960
MPASWTSPQKSSALAPEDHGSSYEGSVSFRDVAIDFSREEWRHLDLSQRNLYRDVMLETYSHLLSVGYQVPKPEVVMLEQGKEPWALQGERPRHSCPGFWVSLGSPWARFSSRLQPISSEQLCLSSQMTAKLQTPYRKRVETQCGHAS

SEQ ID NO: 20359 - protein, 56 aa, Homo sapiens
  Payload ID: 4080
  Gene Symbol:
  Gene Name: CTC-454I21.3
  ENSP ID: ENSP00000467945
MPASWTSPQKSSALAPEDHGSSYEVYRYHFQRNDVLSPISTINMHHKRQTVISECS

SEQ ID NO: 20360 - protein, 77 aa, Homo sapiens
  Payload ID: 4081
  Gene Symbol:
  Gene Name: CTC-479C5.12
  ENSP ID: ENSP00000463376
  MOD_RES (1)..(1): Any amino acid
XQLYGVHPHGSYSRLPFTALGSGQDAALAVLEDRFQPNMTVSGLCPRLCGRWWDVHPGAGGAQDPGPVRVAKACRRR

SEQ ID NO: 20361 - protein, 123 aa, Homo sapiens
  Payload ID: 4082
  Gene Symbol:
  Gene Name: CTC-479C5.6
  ENSP ID: ENSP00000488973
MTDRILYIVSNMSSVPWEGSAAAAVPATSPPTPGHYHVLYRGCGETQVGWHGETYCLVGGYRVHGDAPLATPTKAEAEKPAPRRAPKRRQATIESDKDLGCSSPKIRRLEHRGRRLTPQKLAG

SEQ ID NO: 20362 - protein, 43 aa, Homo sapiens
  Payload ID: 4083
  Gene Symbol:
  Gene Name: CTC-487M23.8
  ENSP ID: ENSP00000424153
MACAAARSPADQDRFICIYPAYLNNKKTIAEGRRIPISKCLCF

SEQ ID NO: 20363 - protein, 66 aa, Homo sapiens
  Payload ID: 4084
  Gene Symbol:
  Gene Name: CTC-490E21.12
  ENSP ID: ENSP00000469533
  MOD_RES (1)..(1): Any amino acid
XVEGHEPGCRSIGALMAHVDAVIRHCAGRLGSYVINGRTKLREKYSPVFTVYMGPGQWWFYVDTKQ

SEQ ID NO: 20364 - protein, 159 aa, Homo sapiens
  Payload ID: 4085
  Gene Symbol:
  Gene Name: CTC-512J12.6
  ENSP ID: ENSP00000468271
MIKFQMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFT

SEQ ID NO: 20365 - protein, 250 aa, Homo sapiens
  Payload ID: 4086
  Gene Symbol:
  Gene Name: CTC-534A2.2
  ENSP ID: ENSP00000424007
MTTEVILHYRPCESDPTQLPKIAEKAIQDFPTRPLSRFIPWFPYDGSKLPLRPKRSPPVISEEAAEDVKQYLTISEHDAKSHSYDCTVDLLEFQPSLKKQHLTWSHTLKEQTNSGNLGKQSEKGKQHKRRSWSISLPSNNCTKNVSPLSKKLQDSLKALNLHSLYRARWTIEHTICNSQTLEDIWTKLNQIIRHNELPSCNATIQRHLGQIWVFCDIMYCEYVGSLLKGRLALTGKINLFVHKYGVIFSM

SEQ ID NO: 20366 - protein, 4 aa, Homo sapiens
  Payload ID: 4086
  Gene Symbol:
  Gene Name: CTC-534A2.2
  ENSP ID: ENSP00000485631
MTTE

SEQ ID NO: 20367 - protein, 94 aa, Homo sapiens
  Payload ID: 4087
  Gene Symbol:
  Gene Name: CTC-554D6.1
  ENSP ID: ENSP00000454861
  MOD_RES (1)..(1): Any amino acid
XTNLTFGDVANKATLCSMKGCMRALVAQLKSESEDLQQVIASVLRNLSWRADVNSKKTLREVGSVKALMECALEVKKMALQKQFHGLFVSILLI

SEQ ID NO: 20368 - protein, 867 aa, Homo sapiens
  Payload ID: 4088
  Gene Symbol: CTDP1
  Gene Name: CTD (carboxy-terminal domain, RNA polymerase II, polypeptide A) phosphatase, subunit 1
  Uniprot ID: Q9Y5B0
  ENSP ID: ENSP00000075430
MEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRWTTSLEKAATTATARRGGLRSRRRSPSPGSQGPAGSGRSGHLRPARGARQGAGGPEATRGS

SEQ ID NO: 20369 - protein, 842 aa, Homo sapiens
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000299543
MKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 20370 - protein, 799 aa, Homo sapiens
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000465119
ASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKERPQEEAE

SEQ ID NO: 20371 - protein, 78 aa, Homo sapiens
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000467563
MKGLCAECGQDLTQLQSKNGKQQVPLSTATVSMVHSVPELMVSSEQAEQLGREDQQRLHRNRKLVLMVDLDQTLIHTT

SEQ ID NO: 20372 - protein, 961 aa, Homo sapiens
  Payload ID: 4088
  Gene Symbol: CTDP1
  Gene Name: CTD (carboxy-terminal domain, RNA polymerase II, polypeptide A) phosphatase, subunit 1
  Uniprot ID: Q9Y5B0
  ENSP ID: ENSP00000484525
MEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPASSERSAAGGRGPRGHKRKLNEEDAASESSRESSNEDEGSSSEADEMAKALEAELNDLM

SEQ ID NO: 20373 - protein, 805 aa, Homo sapiens
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000487888
MEVPAAGRVPAEGAPTAAVAEVRCPGPAPLRLLEWRVAAGAAVRIGSVLAVFEAAASAQSSGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSF

SEQ ID NO: 20374 - protein, 805 aa, Homo sapiens; identical to SEQ ID NO: 20373
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000487949

SEQ ID NO: 20375 - protein, 737 aa, Homo sapiens
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000487989
ASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDREDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSF

SEQ ID NO: 20376 - protein, 78 aa, Homo sapiens; identical to SEQ ID NO: 20371
  Payload ID: 4088
  Gene Symbol: CTDP1
  Gene Name: CTD (carboxy-terminal domain, RNA polymerase II, polypeptide A) phosphatase, subunit 1
  ENSP ID: ENSP00000488566

SEQ ID NO: 20377 - protein, 261 aa, Homo sapiens
  Payload ID: 4089
  Gene Symbol: CTDSP1
  Gene Name: CTD (carboxy-terminal domain, RNA polymerase II, polypeptide A) small phosphatase 1
  Uniprot ID: Q9GZU7
  ENSP ID: ENSP00000273062
MDSSAVITQISKEEARGPLRGKGDQKSAASQKPRSRGILHSLFCCVCRDDGEALPAHSGAPLLVEENGAIPKQTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 20378 - protein, 260 aa, Homo sapiens
  Payload ID: 4089
  Gene Symbol: CTDSP1
  Gene Name: CTD (carboxy-terminal domain, RNA polymerase II, polypeptide A) small phosphatase 1
  Uniprot ID: Q9GZU7
  ENSP ID: ENSP00000392248
MVAAPWATQEQEEGRGIQPGDRGDQKSAASQKPRSRGILHSLFCCVCRDDGEALPAHSGAPLLVEENGAIPKTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 20379 - protein, 262 aa, Homo sapiens
  Payload ID: 4089
  Gene Symbol: CTDSP1
  Gene Name: CTD (carboxy-terminal domain, RNA polymerase II, polypeptide A) small phosphatase 1
  ENSP ID: ENSP00000403256
  MOD_RES (1)..(1): Any amino acid
XLNSEEAQRRGAGPGAFGALLFARGDQKSAASQKPRSRGILHSLFCCVCRDDGEALPAHSGAPLLVEENGAIPKTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 20380 - protein, 254 aa, Homo sapiens
  Payload ID: 4089
  Gene Symbol: CTDSP1
  Gene Name: CTD (carboxy-terminal domain, RNA polymerase II, polypeptide A) small phosphatase 1
  ENSP ID: ENSP00000404301
  MOD_RES (1)..(1): Any amino acid
XRGPLRGKGDQKSAASQKPRSRGILHSLFCCVCRDDGEALPAHSGAPLLVEENGAIPKTPVQYLLPEAKAQDSDKICVVIDLDETLVHSSFKPVNNADFIIPVEIDGVVHQPPHWPAPQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 20381 - protein, 195 aa, Homo sapiens
  Payload ID: 4089
  Gene Symbol: CTDSP1
  Gene Name: CTD (carboxy-terminal domain, RNA polymerase II, polypeptide A) small phosphatase 1
  ENSP ID: ENSP00000411308
  MOD_RES (1)..(1): Any amino acid
XRRRPPRRHREDGRHFQESLGARGESRAPSGHAPPRKASPPRRGCVPQRGWAGVGGSVFSFSPCGPQDLDAAPRSAHPRLGLAAPELRARWKGDQKSAASQKPRSRGILHSLFCCVCRDDGEALPAHSGAPLLVEENGAIPKTPVQYLLPEAKAQDSDKICVVIDLDETLVHSSFKPVNNADFIIPVEIDGVVHQ

SEQ ID NO: 20382 - protein, 271 aa, Homo sapiens
  Payload ID: 4090
  Gene Symbol: CTDSP2
  Gene Name: CTD (carboxy-terminal domain, RNA polymerase II, polypeptide A) small phosphatase 2
  Uniprot ID: O14595
  ENSP ID: ENSP00000381148
MEHGSIITQARREDALVLTKQGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 20383 - protein, 119 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000446705
MGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 20384 - protein, 98 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000447046
MEHGSIITQARREDALVLTKQGLVSKSSPKKPRGRNIFKTLILDNSPASYIFHPENAVPVQSWFDDMADTELLNLIPIFEELSGAEDVYTSLGQLRAP

SEQ ID NO: 20385 - protein, 182 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000448299
  MOD_RES (1)..(1): Any amino acid
XFKALFCCFRAQHVGQSSSSTELAAYKEEANTIAKSDLLQCLQYQFYQVRDSGLIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRK

SEQ ID NO: 20386 - protein, 125 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000448386
PINNADFIVPIEIEGTTHQVYVLKRPYVDEFLRRMGELFECVLFTASLAKGCYVKDLSRLGRDLRKTLILDNSPASYIFHPENAVPVQSWFDDMADTELLNLIPIFEELSGAEDVYTSLGQLRAP

SEQ ID NO: 20387 - protein, 102 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000448951
MEHGSIITQARREDALVLTKQGLVSKSSPKKPRGRNIFKALFCCFRAQHVGQSSSSTELAAYKEEANTIAKSDLLQCLQYQFYQISATWLGFRSQGPACSQR

SEQ ID NO: 20388 - protein, 282 aa, Homo sapiens
  Payload ID: 4090
  Gene Symbol: CTDSP2
  Gene Name: CTD (carboxy-terminal domain, RNA polymerase II, polypeptide A) small phosphatase 2
  ENSP ID: ENSP00000480551
MEHGSIITQARREDALVLTKQGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGAAGPLACPASKRRPSQ

SEQ ID NO: 20389 - protein, 466 aa, Homo sapiens
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENSP ID: ENSP00000260327
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDSPGQAVEAEEIVKQLDMEQVDEITTSTTTSTNGAAYSNQAVQVRPSLNNGLEEAEETVNRDIPPLTAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 20390 - protein, 466 aa, Homo sapiens; identical to SEQ ID NO: 20389
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENSP ID: ENSP00000452837

SEQ ID NO: 20391 - protein, 394 aa, Homo sapiens
  Payload ID: 4091
  Gene Symbol: CTDSPL2
  Gene Name: CTD (carboxy-terminal domain, RNA polymerase II, polypeptide A) small phosphatase like 2
  Uniprot ID: Q05D32
  ENSP ID: ENSP00000453051
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNAPVTPDSGYSSAHAEATYEEDWEVFDPYYFIKHVPPLTEEQLNRKPALPLKTRSTPEFSLVLDLDETLVHCSLNELEDAALTFPVLFQDVIYQVYVRLRPFFREFLERMSQMYEIILFTASKKVYADKLLNILDPKKQLVRHRLFREHCVCVQGNYIKDLNILGRDLSKTIIIDNSPQAFAYQLSNGIPIESWFMDKNDNELLKLIPFLEKLVELNEDVRPHIRDRFRLHDLLPPD

SEQ ID NO: 20392 - protein, 86 aa, Homo sapiens
  Payload ID: 4091
  Gene Symbol: CTDSPL2
  Gene Name: CTD (carboxy-terminal domain, RNA polymerase II, polypeptide A) small phosphatase like 2
  ENSP ID: ENSP00000453538
  MOD_RES (1)..(1): Any amino acid
XYYFIKHVPPLTEEQLNRKPALPLKTRSTPEFSLVLDLDETLVHCSLNELEDAALTFPVLFQDVIYQWCCLHLLAKKKYTQGSEMI

SEQ ID NO: 20393 - protein, 165 aa, Homo sapiens
  Payload ID: 4091
  Gene Symbol: CTDSPL2
  Gene Name: CTD (carboxy-terminal domain, RNA polymerase II, polypeptide A) small phosphatase like 2
  ENSP ID: ENSP00000453612
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTNQHVKQNGKLEDNPSSGSPPRTTLLGTIFSPVFNFFSPANKNGTSGSDS

SEQ ID NO: 20394 - protein, 92 aa, Homo sapiens
  Payload ID: 4091
  Gene Symbol: CTDSPL2
  Gene Name: CTD (carboxy-terminal domain, RNA polymerase II, polypeptide A) small phosphatase like 2
  ENSP ID: ENSP00000454154
MRLRTRKASQQSNQIQTQRTARAKRKYSEVDDSLPSGGEKPSKNETGLLSSIKKFIKGSTPKEERENPSKRSRIERDIDNNLITSTPRAGEK

SEQ ID NO: 20395 - protein, 117 aa, Homo sapiens
  Payload ID: 4091
  Gene Symbol: CTDSPL2
  Gene Name: CTD (carboxy-terminal domain, RNA polymerase II, polypeptide A) small phosphatase like 2
  ENSP ID: ENSP00000454187
MRLRTRKASQQSNQIQTQRTARAKRKYSEVDDSLPSGGEKPSKNETGLLSSIKKFIKGSTPKEERENPSKRSRIERDIDNNLITSTPRAGEKPNKQISRVRRKSQVNGEAGSYEMTN

SEQ ID NO: 20396 - protein, 276 aa, Homo sapiens
  Payload ID: 4092
  Gene Symbol: CTDSPL
  Gene Name: CTD (carboxy-terminal domain, RNA polymerase II, polypeptide A) small phosphatase-like
  Uniprot ID: O15194
  ENSP ID: ENSP00000273179
MDGPAIITQVTNPKEDEGRLPGAGEKASQCNVSLKKQRSRSILSSFFCCFRDYNVEAPPPSSPSVLPPLVEENGGLQKGDQRQVIPIPSPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 20397 - protein, 265 aa, Homo sapiens
  Payload ID: 4092
  Gene Symbol: CTDSPL
  Gene Name: CTD (carboxy-terminal domain, RNA polymerase II, polypeptide A) small phosphatase-like
  Uniprot ID: O15194
  ENSP ID: ENSP00000398288
MDGPAIITQVTNPKEDEGRLPGAGEKASQCNVSLKKQRSRSILSSFFCCFRDYNVEAPPPSSPSVLPPLVEENGGLQKPPAKYLLPEVTVLDYGKKCVVIDLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNR

SEQ ID NO: 20398 - protein, 93 aa, Homo sapiens
  Payload ID: 4092
  Gene Symbol: CTDSPL
  Gene Name: CTD (carboxy-terminal domain, RNA polymerase II, polypeptide A) small phosphatase-like
  ENSP ID: ENSP00000404977
  MOD_RES (1)..(1): Any amino acid
XKYLLPEVTVLDYGKKCVVIDLDETLVHSSFKPISNADFIVPVEIDGTIHQQATGKCHKSPTYGGLSGKSVHFQCQLLQTDLIIPASFSPENL

SEQ ID NO: 20399 - protein, 196 aa, Homo sapiens
  Payload ID: 4092
  Gene Symbol: CTDSPL
  Gene Name: CTD (carboxy-terminal domain, RNA polymerase II, polypeptide A) small phosphatase-like
  ENSP ID: ENSP00000407443
DLDETLVHSSFKPISNADFIVPVEIDGTIHQVYVLKRPHVDEFLQRMGQLFECVLFTASLAKYADPVADLLDRWGVFRARLFRESCVFHRGNYVKDLSRLGRELSKVIIVDNSPASYIFHPENAVPVQSWFDDMTDTELLDLIPFFEGLSREDDVYSMLHRLCNSNEASCQLHPPNSTLVCGLLCEYSEGKSFSAD

SEQ ID NO: 20400 - protein, 55 aa, Homo sapiens
  Payload ID: 4092
  Gene Symbol: CTDSPL
  Gene Name: CTD (carboxy-terminal domain, RNA polymerase II, polypeptide A) small phosphatase-like
  ENSP ID: ENSP00000408183
MDGPAIITQVTNPKEDEGRLPGAGEKDSLSEKGKKTSGRRIRKLSTHLGGRCNPR

SEQ ID NO: 20401 - protein, 103 aa, Homo sapiens
  Payload ID: 4092
  Gene Symbol: CTDSPL
  Gene Name: CTD (carboxy-terminal domain, RNA polymerase II, polypeptide A) small phosphatase-like
  ENSP ID: ENSP00000409600
  MOD_RES (1)..(1): Any amino acid
XSCVFHRGNYVKDLSRLGRELSKVIIVDNSPASYIFHPENAVPVQSWFDDMTDTELLDLIPFFEGLSREDDVYSMLHRLCNSWIHMELFGNFPCCYRAATKWN

SEQ ID NO: 20402 - protein, 244 aa, Homo sapiens
  Payload ID: 4093
  Gene Symbol: CTDNEP1
  Gene Name: CTD nuclear envelope phosphatase 1
  Uniprot ID: O95476
  ENSP ID: ENSP00000321732
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 20403 - protein, 125 aa, Homo sapiens
  Payload ID: 4093
  Gene Symbol: CTDNEP1
  Gene Name: CTD nuclear envelope phosphatase 1
  ENSP ID: ENSP00000458408
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWY

SEQ ID NO: 20404 - protein, 244 aa, Homo sapiens; identical to SEQ ID NO: 20402
  Payload ID: 4093
  Gene Symbol: CTDNEP1
  Gene Name: CTD nuclear envelope phosphatase 1
  Uniprot ID: O95476
  ENSP ID: ENSP00000458758

SEQ ID NO: 20405 - protein, 202 aa, Homo sapiens
  Payload ID: 4093
  Gene Symbol: CTDNEP1
  Gene Name: CTD nuclear envelope phosphatase 1
  ENSP ID: ENSP00000458763
  MOD_RES (1)..(1): Any amino acid
XQCLLGLRTFVAFAAKLWSFFIYLLRRQIRTVIQYQTVRYDILPLSPVSRNRLAQVKRKILVLDLDETLIHSHHDGVLRPTVRPGTPPDFILKVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTAD

SEQ ID NO: 20406 - protein, 111 aa, Homo sapiens
  Payload ID: 4093
  Gene Symbol: CTDNEP1
  Gene Name: CTD nuclear envelope phosphatase 1
  ENSP ID: ENSP00000459866
MEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 20407 - protein, 208 aa, Homo sapiens
  Payload ID: 4093
  Gene Symbol: CTDNEP1
  Gene Name: CTD nuclear envelope phosphatase 1
  ENSP ID: ENSP00000460527
  MOD_RES (1)..(1): Any amino acid
XQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRL

SEQ ID NO: 20408 - protein, 244 aa, Homo sapiens; identical to SEQ ID NO: 20402
  Payload ID: 4093
  Gene Symbol: CTDNEP1
  Gene Name: CTD nuclear envelope phosphatase 1
  Uniprot ID: O95476
  ENSP ID: ENSP00000460683

SEQ ID NO: 20409 - protein, 223 aa, Homo sapiens
  Payload ID: 4093
  Gene Symbol: CTDNEP1
  Gene Name: CTD nuclear envelope phosphatase 1
  ENSP ID: ENSP00000461122
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDA

SEQ ID NO: 20410 - protein, 67 aa, Homo sapiens
  Payload ID: 4093
  Gene Symbol: CTDNEP1
  Gene Name: CTD nuclear envelope phosphatase 1
  ENSP ID: ENSP00000461567
MMRTQCLLGLRTFVAFAAKLWSFFIYLLRRQIRTVIQYQTVRYDILPLSPVSRNRLGEEEDPGAGSG

SEQ ID NO: 20411 - protein, 244 aa, Homo sapiens; identical to SEQ ID NO: 20402
  Payload ID: 4093
  Gene Symbol: CTDNEP1
  Gene Name: CTD nuclear envelope phosphatase 1
  Uniprot ID: O95476
  ENSP ID: ENSP00000461749

SEQ ID NO: 20412 - protein, 64 aa, Homo sapiens
  Payload ID: 4094
  Gene Symbol: CNEP1R1
  Gene Name: CTD nuclear envelope phosphatase 1 regulatory subunit 1
  ENSP ID: ENSP00000373786
MNSLEQAEAPRVVSLIPAVVSGNCQDLKAFERRLTEYIHCLQPATGRWRSVLLHIIMESPIFHH

SEQ ID NO: 20413 - protein, 125 aa, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENSP ID: ENSP00000394224
MNSLEQAEDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 20414 - protein, 142 aa, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENSP ID: ENSP00000405635
MNSLEQAEAPRVVSLIPAVVSGNCQDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 20415 - protein, 80 aa, Homo sapiens
  Payload ID: 4094
  Gene Symbol: CNEP1R1
  Gene Name: CTD nuclear envelope phosphatase 1 regulatory subunit 1
  ENSP ID: ENSP00000454356
MLLIVVSVCTATGAWNWLIDPETQKVSFFTSLWNHPFFTISCITLIGLFFAGIHKRVVAPSIIAARCRTVLAEYNMSCDD

SEQ ID NO: 20416 - protein, 108 aa, Homo sapiens
  Payload ID: 4094
  Gene Symbol: CNEP1R1
  Gene Name: CTD nuclear envelope phosphatase 1 regulatory subunit 1
  ENSP ID: ENSP00000454676
MNSLEQAEDLKAFERRLTEYIHCLQPATGRWRMLLIVVSVCTATGAWNWLIDPETQKVSFFTSLWNHPFFTISCITLIGLFFAGIHKRVVAPSICSMSNGISRIQYVL

SEQ ID NO: 20417 - protein, 47 aa, Homo sapiens
  Payload ID: 4094
  Gene Symbol: CNEP1R1
  Gene Name: CTD nuclear envelope phosphatase 1 regulatory subunit 1
  Uniprot ID: Q8N9A8
  ENSP ID: ENSP00000456294
MNSLEQAEDLKAFERRLTEYIHCLQPATGRWRSVLLHIIMESPIFHH

SEQ ID NO: 20418 - protein, 125 aa, Homo sapiens; identical to SEQ ID NO: 20413
  Payload ID: 4094
  Gene Symbol: CNEP1R1
  Gene Name: CTD nuclear envelope phosphatase 1 regulatory subunit 1
  Uniprot ID: Q8N9A8
  ENSP ID: ENSP00000456686

SEQ ID NO: 20419 - protein, 47 aa, Homo sapiens; identical to SEQ ID NO: 20417
  Payload ID: 4094
  Gene Symbol: CNEP1R1
  Gene Name: CTD nuclear envelope phosphatase 1 regulatory subunit 1
  Uniprot ID: Q8N9A8
  ENSP ID: ENSP00000456913

SEQ ID NO: 20420 - protein, 93 aa, Homo sapiens
  Payload ID: 4094
  Gene Symbol: CNEP1R1
  Gene Name: CTD nuclear envelope phosphatase 1 regulatory subunit 1
  ENSP ID: ENSP00000457787
MLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 20421 - protein, 76 aa, Homo sapiens
  Payload ID: 4095
  Gene Symbol:
  Gene Name: CTD-2006C1.10
  ENSP ID: ENSP00000458124
MDSVAFEDVAVNFTQEEWALLDPSQKNLYREVMQETLRNLTSIGKKWNNQYIEDEHQNPRRNLRCFRIQWPLRMWL

SEQ ID NO: 20422 - protein, 115 aa, Homo sapiens
  Payload ID: 4096
  Gene Symbol:
  Gene Name: CTD-2006C1.13
  ENSP ID: ENSP00000465172
MPCCSHRSCREDPGTSESREMRPESSDCKLKPVRNLQREVIESSHQAQWLTPVIPALWEAKADGASQMFQDPVACEDVAVNFTQEEWALLDISQRKLYREVMLETFRNLTSIGVS

SEQ ID NO: 20423 - protein, 3 aa, Homo sapiens
  Payload ID: 4096
  Gene Symbol:
  Gene Name: CTD-2006C1.13
  ENSP ID: ENSP00000465998
AFS

SEQ ID NO: 20424 - protein, 414 aa, Homo sapiens
  Payload ID: 4096
  Gene Symbol:
  Gene Name: CTD-2006C1.13
  ENSP ID: ENSP00000467286
MPCCSHRSCREDPGTSESREMDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 20425 - protein, 63 aa, Homo sapiens
  Payload ID: 4096
  Gene Symbol:
  Gene Name: CTD-2006C1.13
  ENSP ID: ENSP00000467438
MPCCSHRSCREDPGTSESREMAGVQWRDLNSLQLLPPEFKGFSCLSLQSSWDYRTLWPVRMLL

SEQ ID NO: 20426 - protein, 117 aa, Homo sapiens
  Payload ID: 4097
  Gene Symbol:
  Gene Name: CTD-2007N20.1
  ENSP ID: ENSP00000486977
MDMRVPAQLLGLLLLWLPGTRCDIQMTQSPSSLSASVGDRVTITCRASQGISNSLAWYQQKPGKAPKLLLYAASRLESGVPSRFSGSGSGTDYTLTISSLQPEDFATYYCQQYYSTP

SEQ ID NO: 20427 - protein, 472 aa, Homo sapiens
  Payload ID: 4098
  Gene Symbol:
  Gene Name: CTD-2105E13.6
  ENSP ID: ENSP00000467419
  MOD_RES (1)..(1): Any amino acid
XAPAVPAPSQKAPAVPAPSQKAPAIPAPSRKASAASASPRKASAVPAPPQKTPPPSQKAPSVPTIPQKAVSPTAPKKKSLLLPAPSQKALPTSPTEYQMALSPPASRGKLPGDFDVLPTGIPGRAVLERSQSGGKPEPVVTVRTQETDVVEMTTQAKSPESPFTVTKKESKDILISQTKEVTLEAFRGQGKLEDWAHWAKLEERSPDLPGVRSKELEQRKRWVKAKELAVEGPSQEHSRPFSVEALTLTKLMITANSKEQPSKSALVSLPSWLLATPQASATSMMASVPSRPGQLSLLEGKPVVVREQPESHTWVKEGKRPWGEMKEQPWGEMKEPPWDPKGPPKVPFRSKPTSASLKREGISQAPIPLTASPWEDLRPSPLSETLISKMEATARASQQPKRVSQEPMRMPAQHPLATVGSSSEILLPMLLELETVRNTATKAEEIQEESGVLNLLPSLQHSQHSEWPDAGA

SEQ ID NO: 20428 - protein, 48 aa, Homo sapiens
  Payload ID: 4099
  Gene Symbol:
  Gene Name: CTD-2116N17.1
  ENSP ID: ENSP00000488914
MVRTKADSVPGTYRKVVAARAPRKVLGSSTSATNSTSVSSRKGYKMFT

SEQ ID NO: 20429 - protein, 116 aa, Homo sapiens
  Payload ID: 4099
  Gene Symbol:
  Gene Name: CTD-2116N17.1
  ENSP ID: ENSP00000489069
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKLQDVHLRLRPSDYISYGNK

SEQ ID NO: 20430 - protein, 19 aa, Homo sapiens
  Payload ID: 4099
  Gene Symbol:
  Gene Name: CTD-2116N17.1
  ENSP ID: ENSP00000489109
  MOD_RES (1)..(1): Any amino acid
XQEPPILQHTEQQAGHTAH

SEQ ID NO: 20431 - protein, 65 aa, Homo sapiens
  Payload ID: 4099
  Gene Symbol:
  Gene Name: CTD-2116N17.1
  ENSP ID: ENSP00000489289
MVRTKADSVPGTYRKVVAARAPRKVLGSSTSATNSTSVSSRKEHVLCNLITQMMKKNRTFSFIFE

SEQ ID NO: 20432 - protein, 111 aa, Homo sapiens
  Payload ID: 4099
  Gene Symbol:
  Gene Name: CTD-2116N17.1
  ENSP ID: ENSP00000489519
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKACPLQPDHTNDEKE

SEQ ID NO: 20433 - protein, 27 aa, Homo sapiens
  Payload ID: 4100
  Gene Symbol:
  Gene Name: CTD-2132N18.3
  ENSP ID: ENSP00000464838
ATGAPGRNRGVDLQENNPASRSQCCSN

SEQ ID NO: 20434 - protein, 161 aa, Homo sapiens
  Payload ID: 4100
  Gene Symbol:
  Gene Name: CTD-2132N18.3
  ENSP ID: ENSP00000468275
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQLTTYPTWRMCQRMR

SEQ ID NO: 20435 - protein, 282 aa, Homo sapiens
  Payload ID: 4100
  Gene Symbol:
  Gene Name: CTD-2132N18.3
  ENSP ID: ENSP00000468367
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAP

SEQ ID NO: 20436 - protein, 440 aa, Homo sapiens
  Payload ID: 4101
  Gene Symbol:
  Gene Name: CTD-2135J3.4
  ENSP ID: ENSP00000451145
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKSWKALTLSQKRPYVDEAERLRLQHMQDYPNYKYRPRRKKQAKRLCKRVDPGFLLSSLSRDQNALPEKRSGSRGALGEKEDRGEYSPGTALPSLRGCYHEGPAGGGGGGTPSSVDTYPYGLPTPPEMSPLDVLEPEQTFFSSPCQEEHGHPRRIPHLPGHPYSPEYAPSPLHCSHPLGSLALGQSPGVSMMSPVPGCPPSPAYYSPATYHPLHSNLQAHLGQLSPPPEHPGFDALDQLSQVELLGDMDRNEFDQYLNTPGHPDSATGAMALSGHVPVSQVTPTGPTETSLISVLADATATYYNSYSVS

SEQ ID NO: 20437 - protein, 358 aa, Homo sapiens
  Payload ID: 4102
  Gene Symbol:
  Gene Name: CTD-2140B24.4
  ENSP ID: ENSP00000457704
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLSIPRVLSLPARHTKLTVGMATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 20438 - protein, 641 aa, Homo sapiens
  Payload ID: 4103
  Gene Symbol:
  Gene Name: CTD-2192J16.17
  ENSP ID: ENSP00000404127
MDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYECSVCGKDYMCHSSLNRHMRSHTEHRSYEYHKYGEKSYECKECGKRFSFRSSFRIHERTHTGEKPYKCKQCGKAFSWPSSFQIHERTHTGEKPYECKECGKAFIYHTTFRGHMRMHTGEKPYKCKECGKTFSHPSSFRNHERTHSGEKPYECKQCGKAFRYYQTFQIHERTHTGEKPYQCKQCGKALSCPTSFRSHERIHTGEKPYKCKKCGKAFSFPSSFRKHERIHTGEKPYDCKECGKAFISLPSYRRHMIMHTGNGPYKCKECGKAFDCPSSFQIHERTHTGEKPYECKQCGKAFSCSSSFRMHERTHTGEKPHECKQCGKAFSCSSSVRIHERTHTGEKPYECKQCGKAFSCSSSFRMHERIHTGEKPYECKQCGKAFSFSSSFRMHERTHTGEKPYECKQCGKAFSCSSSFRMHERTHTGEKPYECKQCGKAFSCSSSIRIHERTHTGEKPYECKQCGKAFSCSSSVRMHERTHTGVKPYECKQCDKAFSCSRSFRIHERTHTGEKPYACQQCGKAFKCSRSFRIHERVHSGE

SEQ ID NO: 20439 - protein, 163 aa, Homo sapiens
  Payload ID: 4104
  Gene Symbol:
  Gene Name: CTD-2192J16.20
  ENSP ID: ENSP00000473043
  MOD_RES (1)..(1): Any amino acid
XGEAFKSSSSCEVHERTHFGEKPYECKQCGKAFNSSSYLQLHERVHTGEKTYECKECGKAFLYSTHFRIHERTHTREKPYECKQCGRVFIYFSHLRRHERSHTGVKPCECKQCGKAFTCLNSLKVHKRIHTGERPFQCRQCGKAFSYSKSLHVHERTHSRQKP

SEQ ID NO: 20440 - protein, 198 aa, Homo sapiens
  Payload ID: 4105
  Gene Symbol:
  Gene Name: CTD-2192J16.22
  ENSP ID: ENSP00000470240
  MOD_RES (1)..(1): Any amino acid
XRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 20441 - protein, 195 aa, Homo sapiens
  Payload ID: 4106
  Gene Symbol:
  Gene Name: CTD-2192J16.24
  ENSP ID: ENSP00000472710
TNNMSDPRRPNKVLRYKPPPSECNPALDDPTPDYMNLLGMIFSMCGLMLKTCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPF

SEQ ID NO: 20442 - protein, 30 aa, Homo sapiens
  Payload ID: 4107
  Gene Symbol:
  Gene Name: CTD-2207O23.10
  ENSP ID: ENSP00000471492
  MOD_RES (1)..(1): Any amino acid
XPASSAAGAARPAAFSAAAEGTPRRSIRCW

SEQ ID NO: 20443 - protein, 47 aa, Homo sapiens
  Payload ID: 4108
  Gene Symbol:
  Gene Name: CTD-2207O23.12
  ENSP ID: ENSP00000469588
KMLKPHRTPPAPVTEEMLQRVLPQKLRAHPRLKCGAQSWSGTQATKA

SEQ ID NO: 20444 - protein, 1122 aa, Homo sapiens
  Payload ID: 4109
  Gene Symbol:
  Gene Name: CTD-2207O23.3
  ENSP ID: ENSP00000482647
  MOD_RES (1)..(1): Any amino acid
XTSVKRRLSCLRSRVTRQKEKGKSPAHLKDKGQDARERRECVNGHQLLQGTFSGPSSCPLCGKPFLSSASLKEHPRGTLLSDGSPALSRNVGMTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPARWRRQHLSPESGRIHFPNRAPRRFTMNLRVRE

SEQ ID NO: 20445 - protein, 108 aa, Homo sapiens; identical to SEQ ID NO: 9704
  Payload ID: 4110
  Gene Symbol:
  Gene Name: CTD-2278I10.6
  ENSP ID: ENSP00000469159

SEQ ID NO: 20446 - protein, 80 aa, Homo sapiens
  Payload ID: 4111
  Gene Symbol:
  Gene Name: CTD-2287O16.3
  ENSP ID: ENSP00000470389
MSKMNEYFSTKYKIMRKYDKSGRLICNDADLCDCLEKNCLGCFYPCPKCNSNKCGPECRCNRRWVYDAIVTESGEVISTL

SEQ ID NO: 20447 - protein, 70 aa, Homo sapiens
  Payload ID: 4112
  Gene Symbol:
  Gene Name: CTD-2313N18.7
  ENSP ID: ENSP00000485141
MRVLFFVFGVLSLMSTVPPTRSFTSNDECPSEYYHCRLKCNADEHAIRYCADFSICCKLKIIQIDGQKKW

SEQ ID NO: 20448 - protein, 487 aa, Homo sapiens
  Payload ID: 4113
  Gene Symbol:
  Gene Name: CTD-2331H12.8
  ENSP ID: ENSP00000489045
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQWQEDETNDHEAPMTEIKKLTSSTDRYDQRHAGNKPIKGQLESRFHLHLRRHRRIHTGEKPYKCEECEKVFSCKSHLEIHRIIHTGEKPYKCKVCDKAFKHDSHLAKHTRIHRGDKHYTCNECGKVFDQKATLACHHRSHTGEKPYKCNECGKTFSQTSHLVYHHRLHTGEKPYKCNECGKTFARNSVLVIHKAVHTAEKPYKCNECGKVFKQRATLAGHRRVHTGEKPYRCEECDKVFSRKSHLERHRRIHTGEKPYKCKVCDKAFRSDSRLAEHQRVHTGERPYTCNECGKVFSTKAYLACHQKLHTGEKLYECEECDKVYIRKSHLERHRRIHTGEKPHKCGDCGKAFNSPSHLIRHQRIHTGQKSYKCHQCGKVFSLRSLLAEH

SEQ ID NO: 20449 - protein, 104 aa, Homo sapiens
  Payload ID: 4114
  Gene Symbol:
  Gene Name: CTD-2349B8.1
  ENSP ID: ENSP00000459737
  MOD_RES (1)..(1): Any amino acid
XHFLPASWRGLASPSEEETPGVRVTGSGAERSGGRARRAAQAMSSCAVATLSGSASCPGLPVWRVTPPSPRDTSESRASASCWRVTTSMRCACLRTCWATARRT

SEQ ID NO: 20450 - protein, 76 aa, Homo sapiens
  Payload ID: 4114
  Gene Symbol:
  Gene Name: CTD-2349B8.1
  ENSP ID: ENSP00000459792
  MOD_RES (1)..(1): Any amino acid
XRGPSNRVRRGEERRESQEGRPGYVLLRCRHAVRQRFLPGSPRLEGHAAFSSRHFREPGLSILLESYYEHESDSVT

SEQ ID NO: 20451 - protein, 145 aa, Homo sapiens
  Payload ID: 4115
  Gene Symbol:
  Gene Name: CTD-2369P2.10
  ENSP ID: ENSP00000408510
MHVMAASMARGGVSARVLLQAARGTWWNRPGGTSGSGEGVALGTTRKFQATGSRPAGEEDAGGPERPGDVVNVVFVDRSGQRIPVSGRVGDNVLHLAQRHGVDLEGACEASLACSTCHVYVSEDHLDLLPPPEERRTRGWAARLC

SEQ ID NO: 20452 - protein, 157 aa, Homo sapiens
  Payload ID: 4116
  Gene Symbol:
  Gene Name: CTD-2369P2.12
  ENSP ID: ENSP00000467814
SYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 20453 - protein, 123 aa, Homo sapiens
  Payload ID: 4117
  Gene Symbol:
  Gene Name: CTD-2370N5.3
  ENSP ID: ENSP00000462030
  MOD_RES (1)..(1): Any amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIAKSPKCPVRTRI

SEQ ID NO: 20454 - protein, 117 aa, Homo sapiens
  Payload ID: 4117
  Gene Symbol:
  Gene Name: CTD-2370N5.3
  ENSP ID: ENSP00000463745
  MOD_RES (1)..(1): Any amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIDNEEIF

SEQ ID NO: 20455 - protein, 171 aa, Homo sapiens
  Payload ID: 4117
  Gene Symbol:
  Gene Name: CTD-2370N5.3
  ENSP ID: ENSP00000463981
MPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIAKSPKCPVRTRI

SEQ ID NO: 20456 - protein, 153 aa, Homo sapiens
  Payload ID: 4117
  Gene Symbol:
  Gene Name: CTD-2370N5.3
  ENSP ID: ENSP00000464508
  MOD_RES (1)..(1): Any amino acid
XCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIEEETVTQKCRVLPKVIQVNRTHHSLLMRRNLTKLFQFARGTF

SEQ ID NO: 20457 - protein, 91 aa, Homo sapiens
  Payload ID: 4118
  Gene Symbol:
  Gene Name: CTD-2410N18.5
  ENSP ID: ENSP00000430774
MDEKVFTKELDQWIEQLNECKQLSESQVKSLCEKMPSIKLQSSDGEIFEVDVEIAKQSVTIKTMLEDLGMDDEGDDDPVPLPNVNAAILKK

SEQ ID NO: 20458 - protein, 739 aa, Homo sapiens
  Payload ID: 4119
  Gene Symbol:
  Gene Name: CTD-2501B8.1
  ENSP ID: ENSP00000464149
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSDDFYNETETKIFLQFYDQTGIWDHGAPHLLPPSQARGTREAPVYMSKRAASSGPPGSPKLPPAAQGHGEVPVHDLLWHPGPPV

SEQ ID NO: 20459 - protein, 110 aa, Homo sapiens
  Payload ID: 4120
  Gene Symbol:
  Gene Name: CTD-2510F5.6
  ENSP ID: ENSP00000464167
DLRKLLRKVDVERSPGGTPLTNKENMETGTGLTPVMTQALRRKFQVQPGPPPCPVFYPEKQEITLPPDGLWVLRFPYAYVTERGPCFPPKENVQLMSYKVLRGVLKAVTQ

SEQ ID NO: 20460 - protein, 226 aa, Homo sapiens
  Payload ID: 4121
  Gene Symbol:
  Gene Name: CTD-2521M24.10
  ENSP ID: ENSP00000472415
MPKKWLFLPFEDDLRRDLGRQFSVERLPAVVVLKPDGDVLTRDGADEIQRLGTACFANWQEAAEVLDRNFQLPEDLEDQEPRSLTECLRRHKSDWFLYDCRLLRHVALGLFCCGISVYLAALSIYALLLFEIETGAAAASILGSGTLVLVAVLTHTLLRAARAARRGLHELSPPSFEDDLARPAEVSKASPRAQPQQGIHRRTPYSTCPEPGDPFGSMATATAPAA

SEQ ID NO: 20461 - protein, 64 aa, Homo sapiens
  Payload ID: 4122
  Gene Symbol:
  Gene Name: CTD-2528L19.4
  ENSP ID: ENSP00000464957
MIVREETRGECTDLDSRCEIISDGKMQLYRKHSCVTLHQRIHNGQKPYEWNTTDLRSLGLRNNL

SEQ ID NO: 20462 - protein, 39 aa, Homo sapiens
  Payload ID: 4122
  Gene Symbol:
  Gene Name: CTD-2528L19.4
  ENSP ID: ENSP00000466284
MQLYRKHSCVTLHQRIHNGQKPYEWNTTDLRSLGLRNNL

SEQ ID NO: 20463 - protein, 130 aa, Homo sapiens
  Payload ID: 4122
  Gene Symbol:
  Gene Name: CTD-2528L19.4
  ENSP ID: ENSP00000467889
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYEWNTTDLRSLGLRNNL

SEQ ID NO: 20464 - protein, 46 aa, Homo sapiens
  Payload ID: 4123
  Gene Symbol:
  Gene Name: CTD-2535L24.2
  ENSP ID: ENSP00000462418
  MOD_RES (1)..(1): Any amino acid
XLKGLMPASLRQELEDTISSLKSQVNFLQKRASILQEELTTYQGRR

SEQ ID NO: 20465 - protein, 29 aa, Homo sapiens
  Payload ID: 4124
  Gene Symbol:
  Gene Name: CTD-2545G14.7
  ENSP ID: ENSP00000466023
  MOD_RES (1)..(1): Any amino acid
XNAIPIKSWFSDPSDTALLNLLPMLDALR

SEQ ID NO: 20466 - protein, 397 aa, Homo sapiens
  Payload ID: 4125
  Gene Symbol:
  Gene Name: CTD-2545M3.6
  ENSP ID: ENSP00000473233
  MOD_RES (1)..(1): Any amino acid
XGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTRLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 20467 - protein, 92 aa, Homo sapiens
  Payload ID: 4126
  Gene Symbol:
  Gene Name: CTD-2561J22.3
  ENSP ID: ENSP00000473166
EFSLEEWQCLDTAQQDLYRKVMLENYRNLVFLAGIAVSKPDLVTCLEQGKDPWNMKGHSTVVKPPGGDCSIFLMEHQGDVTLLPGPCPQRRL

SEQ ID NO: 20468 - protein, 84 aa, Homo sapiens
  Payload ID: 4127
  Gene Symbol:
  Gene Name: CTD-2574D22.6
  ENSP ID: ENSP00000457363
  MOD_RES (1)..(1): Any amino acid
XDEPVTPKDSLIDRRRTPGSSARSQKREARLDKVLSDMKRHKKLEEQILRTGRDLFSLDSEDPSPASPPLRSSGSSLFPRQRKY

SEQ ID NO: 20469 - protein, 71 aa, Homo sapiens
  Payload ID: 4128
  Gene Symbol:
  Gene Name: CTD-2583A14.10
  ENSP ID: ENSP00000469133
MCGLILEDVFHFADHQETHHKQKLNRSGACGKNLDDTAYLHQHQKQHIGEKFYRKSVREASFVKKRKLRVS

SEQ ID NO: 20470 - protein, 166 aa, Homo sapiens
  Payload ID: 4128
  Gene Symbol:
  Gene Name: CTD-2583A14.10
  ENSP ID: ENSP00000471077
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVS

SEQ ID NO: 20471 - protein, 133 aa, Homo sapiens
  Payload ID: 4128
  Gene Symbol:
  Gene Name: CTD-2583A14.10
  ENSP ID: ENSP00000472427
MLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFG

SEQ ID NO: 20472 - protein, 11 aa, Homo sapiens
  Payload ID: 4128
  Gene Symbol:
  Gene Name: CTD-2583A14.10
  ENSP ID: ENSP00000472484
MLENLALISSL

SEQ ID NO: 20473 - protein, 132 aa, Homo sapiens
  Payload ID: 4128
  Gene Symbol:
  Gene Name: CTD-2583A14.10
  ENSP ID: ENSP00000473738
MAAAAPRRPTQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTA

SEQ ID NO: 20474 - protein, 60 aa, Homo sapiens
  Payload ID: 4128
  Gene Symbol:
  Gene Name: CTD-2583A14.10
  ENSP ID: ENSP00000474684
MAVVATLRLSAQGTVTFEDVAVKFTQEEWNLLSEAQRCLYRDVTLENLALMSSLAGHCDL

SEQ ID NO: 20475 - protein, 42 aa, Homo sapiens
  Payload ID: 4129
  Gene Symbol:
  Gene Name: CTD-2583A14.9
  ENSP ID: ENSP00000470782
MLENLALISSLDCPLHLCQFPDLSPCWRVCLERLLSARSALW

SEQ ID NO: 20476 - protein, 172 aa, Homo sapiens
  Payload ID: 4130
  Gene Symbol:
  Gene Name: CTD-2587H24.4
  ENSP ID: ENSP00000473050
  MOD_RES (1)..(1): Any amino acid
XAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQVSSGSLKQPGGD

SEQ ID NO: 20477 - protein, 43 aa, Homo sapiens
  Payload ID: 4131
  Gene Symbol:
  Gene Name: CTD-2616J11.11
  ENSP ID: ENSP00000469452
MVLAVGVGVVGMVMGLRIRCDEGESLRGQTTSAFLFLGDPSEA

SEQ ID NO: 20478 - protein, 630 aa, Homo sapiens
  Payload ID: 4132
  Gene Symbol:
  Gene Name: CTD-3074O7.11
  ENSP ID: ENSP00000398526
MDPSWRRSSHSWPQPMPDSGRAPVRPHLAKLEEDVWPCPQFHQTKAASGPPFVNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 20479 - protein, 3231 aa, Homo sapiens
  Payload ID: 4133
  Gene Symbol:
  Gene Name: CTD-3088G3.8
  ENSP ID: ENSP00000470478
MTACTGSAGPHLPVGTRYTYHFSTNTSTSLQDVLVEGSGLGLQGLAVLDVLGLCQMALWLQDFQVTSILGAKVELLKESESLSATLGRNPLRFILHSGRVAHLCPHPTEPRWVLNVKRAVLSLLQGHPGAHSPKTFDEVDILGRCPTTYQHHGDWLHKTKDLARCSLRRGRSSLHSQALPGVAPGLTSRLTCVQSFRAGVLREASCTELDSAGPLPAKASAVQMRTLSSLSLLHEMPQDPAGTDPDDRDDEDMTPSSLLYEWEETPSQAMVATAATLVRRLCLAQTTSLEAMDLFLTLVSQLQGLSGGELMELWQYSSFKCRDNGQPLLDALPSCGTEHCVGLMKELIASAAVEADEVEAWLSSLAFLPQPTDAMVHMLLPLLQTPRASPGAFLGISALVHNLCASLDGPCGQLPGVGSLVRILGDALGENCTIQEPSDDDKLQLVLKAVGNAGLAAMALTPTLSACASLRSSTPEIRLGAIQAFRRVPCSADRSVLSRLYQSLEEDAEIRINAYLALMRCPSEEVFAQVRRTQAGELSTQVGSFVWSHILQLLETHDPLKRALRDTLPEDILSQEFHPEMWKHSSYSDVTFRSVSGSLGANLEGTLLFSPASFLPRSATVNLTIHTMGRAFNLLELGLRLENAEEIAHRLFGRKSFWGQEDGREPEPEEPPGPEPGPAPQPASPECPGDRDRRMRYLQQKVTRRRGARQALRCELSVKLLGQELSFVNCGATGSHVNHWPLNLAELAIKLMKGQEVQMNRRLSLAAQELVFPTVSGLPARLTLNASAAISIRVRGTTDFQQRSDFSVNGYVKPSALLQISAQMGTAGILGQAGLRWVTSVRSAASLDGGIQVQKGRVLKVHLNTPEEAVELLSFSSQLYLITRDGVRSLRHVPGPSEVQSCTGEEVSYTWGWRLCTGVTWPVPGQPYLLSLPVFAAVTLQKRDPGLRQYLLEAAYTLQPQKGSWFPQEATAHVFMGTPGSEVLRDVGVDMSYSLPQNKFRLKLLHPKKKIELDGKMEALGSAHTGHLELVLDDRDVYYIKGWSDLQPAMGGEAERFQAQLEVKLVTGGSPVVFTGNLTRQVGSKLAFSASLSHLLSDQANVTALLERKEENGRRVAALGAELFVPGLVGLRALGLLQQRGQLWTNSLRIQYSLLGQAKQAAHECSTSQKLRADSGSDGAYRLELRHELHCTQILAFSHKVQLWHEEDSGHLHSQLEVSYGKHWDKNSNKRHLRVSQTFKNDSGPALSNHFMEFVLQVPERQVDCRVQLYHLSLRLPYVESSSHLKVQYNGRPLFVAGGQWKDTSRATLWKWEGALNLDSPWLMVSAAHRLYWPHRAVFQAVLELTLGKAWTLKDLVVSVGCRSQGPNREGKIQVYTAATTYLRVSTVTVLAQSLFHSWSELESAWNAAVQGEIHAENSRDRKILNCWLKGPQQELNLTAAYRHLEWPRKTQVSLTAVRIGAQGQPRGLQLEGELEELRQDRTLYRKRGALLLRHPLHLPIPQSLLLQETFTADRRHQRYSLETRVVLNGREETLQTMVLGCQAGHPYVCAGLMHPYDGKVIPRNTEGCLVTWNQHTAKNREVEATLKVHRKVVLHLKGLHHDRSQHGEIRHSLALDLAHSYQLSFPQALSLDGGIIFRQSPQGTFNFGMDARAAVNHNVTSQASVQLNGSDSDFAFFFQLRHPHGPTFPPNFQVQAAAGRYRVRSLNGSLSVQMSGRELVLLEVDASQDTRRSSRGWGVSVLLHQAVLSAPRAVRLQLSAKITPARIWLFSKALLDQNTAQLLLKASEEWRGGRILTFQSQTRHTVAGWAAMPRLLTLTGRLKQKETLQEGTLSVTADSAVLGFLLRDQHEKAGNGTSVRSVTCVLAQNSSQALPGELQLKGRLQAQTRNLRAQASIRAHAASLALGGACSWGPRHGQLAGGPTHNISTLSDAGLPSEAGMLLSLTHVASNCSARLALWNAGAQLDGAIGLEDVTPESSGLQLHASLRHTHTMPSLKHWGLPFSLDGHGHFQVNCSGDASPTQLLGWCRGDIAGQPLEVSVDIHNGSSGFEHSGRILMGPTFLNYSVSCYYHDGHLELSGRSWHNSEALLWAGFPGEACLSAELQIHETQTQARVALHGGDSGVSMDLAALVARPRRGPLQLVASASHTVPALQRLGLPFTNQLVFQGLWEAEEMSSSLQLTCDSQATLVLDVRGQNQAVSKELLFSGRHRLPFLLGLCPSSASASAKLHYSKGEVQSMFALGVEERHFHISTRQVAAKAGLNNFIKLEQTFLQLSALPRELFLQTAYERAHGTRVLRQVVLWDGQEVALTGSLSGPFPKPTRNLSLQVELTHPLPLPLPRHCSLRLSSEHLGGSHRDGLVVGWDGRDQVLVSSSLWLGKSELAARLALAHPFNLPWRQAEASGLAESRGGRQSRQVQLTWNRGQPATLQLTWADGSLAHSTAWDGCLAASPGQLQETWGLNSLQACGAFTQTPAVFVEQLNVSWGQHRMRQNLTYERHWPSQPDKIIMEATLEHVLGASCTRQSFWGEVQTDYARWLRHSLHLGLCDLPRALLVVGEHTLGQGGLLLRSRCHLGLAPDPDHGLHLSLTLQNHSRPRSADFSGALELRGSKAQRVGLLGRVSTSTSQSLVRLEGSVDNREEKVRLSVFRAPSCLQASVAHEEGGREESVVLRACAHGRTAEAEVLFRDGRQPSQPLGRLTLQAANQSLLLAARGCQGGLLGHVESRIAAVGSQVQARLEEKVQGLGASVRRFQQLVQPAGTLDGVAGLLLQLSQAGREAMQASGWAVATLWARSQALTQHLPLYLEWLQVGLEQLREELEWPLATLKDAYLEVTLRPLEEVWRERAEEAMRRLQAWVPGMPGKGGPRPIRAALGAMKGALELAAQQMLSWAEATFSRALKRLCKPLLDLYSLSARNRSVVVMLPLLPAGDEPLDVARVTSYLMEEKLLRPLRELSGANVLAEYYWLRRRLLAGPWEYHALVAGAQHVVTFDGRVWDLSTQCGSILLAQDFAHNTFSLTLSRTGSGLTALFVELNHKTLILYPSLQAYRLYNSSLPGDSCPDLKLHPATTRKDVSRIELASEDGVSVSCDVPTGLCSLTLGLWQHGISAGLLGTNDNEAGNELMLPDGSMARSLEELSLAWQVGGDCRATEKPQQEQACPGQLPACWAFFEGPHSSLRDCFRVVDPTPFLSLCVQVPCGTQELQPACNLAAAYIHLCARGFVPLAPPPQCV

SEQ ID NO: 20480 - protein, 79 aa, Homo sapiens
  Payload ID: 4133
  Gene Symbol:
  Gene Name: CTD-3088G3.8
  ENSP ID: ENSP00000471908
EEVFAQVRRTQAGELSTQVGSFVWSHILQLLETHDPLKRALRDTLPEDILSQEFHPEMWKHSSYSDVTFRSAWAPAGKC

SEQ ID NO: 20481 - protein, 46 aa, Homo sapiens
  Payload ID: 4133
  Gene Symbol:
  Gene Name: CTD-3088G3.8
  ENSP ID: ENSP00000472593
AAAYIHLCARGFVPLAPPPQCDTIPTRWIHLPPVIQSNTNLGVAVQ

SEQ ID NO: 20482 - protein, 455 aa, Homo sapiens
  Payload ID: 4133
  Gene Symbol:
  Gene Name: CTD-3088G3.8
  ENSP ID: ENSP00000472859
  MOD_RES (1)..(1): Any amino acid
XAGREGSRLGCLCEKVPAIGAAGRHPGRRGRPPSAAVPGGAGGHAGPLATLKDAYLEVTLRPLEEVWRERAEEAMRRLQAWVPGMPGKGGPRPIRAALGAMKGALELAAQQMLSWAEATFSRALKRLCKPLLDLYSLSARNRSVVVMLPLLPAGDEPLDVARVTSYLMEEKLLRPLRELSGANVLAEYYWLRRRLLAGPWEYHALVAGAQHVVTFDGRVWDLSTQCGSILLAQDFAHNTFSLTLSRTGSGLTALFVELNHKTLILYPSLQAYRLYNSSLPGDSCPDLKLHPATTRKDVSRIELASEDGVSVSCDVPTGLCSLTLGLWQHGISAGLLGTNDNEAGNELMLPDGSMARSLEELSLAWQVGGDCRATEKPQQEQACPGQLPACWAFFEGPHSSLRDCFRVVDPTPFLSLCVQVPCGTQELQPACNLAAAYIHLCARGFVPLAPPPQCV

SEQ ID NO: 20483 - protein, 46 aa, Homo sapiens
  Payload ID: 4134
  Gene Symbol:
  Gene Name: CTD-3105H18.14
  ENSP ID: ENSP00000394047
MDSVAFEDVAVNFTQEEWALLGPCQKNLYEDVMQETIRNLDCVGMK

SEQ ID NO: 20484 - protein, 149 aa, Homo sapiens
  Payload ID: 4135
  Gene Symbol:
  Gene Name: CTD-3105H18.16
  ENSP ID: ENSP00000471613
MASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKA

SEQ ID NO: 20485 - protein, 80 aa, Homo sapiens
  Payload ID: 4136
  Gene Symbol:
  Gene Name: CTD-3105H18.18
  ENSP ID: ENSP00000471607
MDSVVFEDVAVNFTQEEWALLGPSQKKLYRDVMQETFVNLASIGENWEEKNIEDHKNQGRKLRDGVLPCCPDWSQTPELK

SEQ ID NO: 20486 - protein, 72 aa, Homo sapiens
  Payload ID: 4137
  Gene Symbol:
  Gene Name: CTD-3148I10.9
  ENSP ID: ENSP00000470318
  MOD_RES (1)..(1): Any amino acid
XQVFQAGDVPSERPFYPPTLVSNLPPASPCAQVEAPGGHCLDQRPRPQRPFGAHRRLQGEWVFLARGPRRAV

SEQ ID NO: 20487 - protein, 137 aa, Homo sapiens
  Payload ID: 4138
  Gene Symbol:
  Gene Name: CTD-3214H19.16
  ENSP ID: ENSP00000469811
  MOD_RES (1)..(1): Any amino acid
XVQACEERQKRGWDSVQQSITMVRSKIDRLETTLAGIKNIDTKVQKILEVLQKMPRWRRHGGALHAREVGAAGARAGAAAHRGEPERLRTAVLRAGTALPEPRLLRGRAAVAPGRAGPPGGRARAGCAGGARKGCPA

SEQ ID NO: 20488 - protein, 48 aa, Homo sapiens
  Payload ID: 4139
  Gene Symbol:
  Gene Name: CTD-3214H19.4
  ENSP ID: ENSP00000469553
  MOD_RES (1)..(1): Any amino acid
XGVKLEIFRMIIYLTFPVAMFWVSNQAEWFEDDVIQRKRELWPPEKKF

SEQ ID NO: 20489 - protein, 51 aa, Homo sapiens
  Payload ID: 4139
  Gene Symbol:
  Gene Name: CTD-3214H19.4
  ENSP ID: ENSP00000470078
MGVKLEIFRMIIYLTFPVAMFWVSNQAEWFEDDVIQRKRELWPPEKFLGAE

SEQ ID NO: 20490 - protein, 61 aa, Homo sapiens
  Payload ID: 4139
  Gene Symbol:
  Gene Name: CTD-3214H19.4
  ENSP ID: ENSP00000472796
MGVKLEIFRRELWPPEKGPRGHSPVGPRRPGQAERLQGRHSQSGRGPRENPLPAADNGPGS

SEQ ID NO: 20491 - protein, 427 aa, Homo sapiens
  Payload ID: 4140
  Gene Symbol:
  Gene Name: CTD-3222D19.2
  ENSP ID: ENSP00000386951
MTAAPASPQQIRDRLLQAIDPQSNEVRCETTVIRNMVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLPGQRLDRLGSRKRRGDQRDLGHPGPPPKVSKASHDPLVPNSSPLPTNGISGSPESFASSLDGSGHAGPEGSRLERDENDKHSGKIPVNAVRPHTSSPGLGKPPGPCLQPKASVLQQLDRVDETPGPPHPKGPPRCSFSPRNSRHEGSFARQQSLYAPKGSVPSPSPRPQALDATQVPSPLPLAQPSTPPVRRLELLPSAESPVCWLEQPESHQRLAGPGCKAGLSPAEPLLSRAGFSPDSSKADSDAASSGGSDSKKKKRSCEIHGSTISGCSTSWAATPSSL

SEQ ID NO: 20492 - protein, 440 aa, Homo sapiens
  Payload ID: 4141
  Gene Symbol: CTBP1
  Gene Name: C-terminal binding protein 1
  Uniprot ID: Q13363
  ENSP ID: ENSP00000290921
MGSSHLLNKGLPLGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 20493 - protein, 429 aa, Homo sapiens
  Payload ID: 4141
  Gene Symbol: CTBP1
  Gene Name: C-terminal binding protein 1
  Uniprot ID: Q13363
  ENSP ID: ENSP00000372411
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 20494 - protein, 145 aa, Homo sapiens
  Payload ID: 4141
  Gene Symbol: CTBP1
  Gene Name: C-terminal binding protein 1
  ENSP ID: ENSP00000420983
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRV

SEQ ID NO: 20495 - protein, 184 aa, Homo sapiens
  Payload ID: 4141
  Gene Symbol: CTBP1
  Gene Name: C-terminal binding protein 1
  ENSP ID: ENSP00000422148
  MOD_RES (1)..(1): Any amino acid
XAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYSRYPPGVVGVAPTGIPAAVEGIVPSAMSLSHGLPPVAHPPHAPSPGQTVKPEADRDHASDQL

SEQ ID NO: 20496 - protein, 287 aa, Homo sapiens
  Payload ID: 4141
  Gene Symbol: CTBP1
  Gene Name: C-terminal binding protein 1
  ENSP ID: ENSP00000422364
  MOD_RES (1)..(1): Any amino acid
XLEKFKALRIIVRIGSGFDNIDIKSAGDLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 20497 - protein, 24 aa, Homo sapiens
  Payload ID: 4141
  Gene Symbol: CTBP1
  Gene Name: C-terminal binding protein 1
  ENSP ID: ENSP00000422730
  MOD_RES (1)..(1): Any amino acid
XIRGETLGIIGLGAHRKTLYTFTP

SEQ ID NO: 20498 - protein, 168 aa, Homo sapiens
  Payload ID: 4141
  Gene Symbol: CTBP1
  Gene Name: C-terminal binding protein 1
  ENSP ID: ENSP00000423872
MSGVRPPIMNGPLHPRPLVALLDGRDCTVEMPILKDVATVAFCDAQSTQEIHEKVPPRGRLGLAEPHVGGSWRDGSTAGPGHSRSGCHWGRSSLCPSRPAPSGGGHGVFPGHHQEVDIGFALSPIRRWTRGFPCAPSGGGHHVCPEPHQEVDIRFALCPIRRWTRGFP

SEQ ID NO: 20499 - protein, 145 aa, Homo sapiens
  Payload ID: 4141
  Gene Symbol: CTBP1
  Gene Name: C-terminal binding protein 1
  ENSP ID: ENSP00000424575
  MOD_RES (1)..(1): Any amino acid
XGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFRCPHGQCRPPALPCPPSCRP

SEQ ID NO: 20500 - protein, 186 aa, Homo sapiens
  Payload ID: 4141
  Gene Symbol: CTBP1
  Gene Name: C-terminal binding protein 1
  ENSP ID: ENSP00000424684
MCRRLSDGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALR

SEQ ID NO: 20501 - protein, 171 aa, Homo sapiens
  Payload ID: 4141
  Gene Symbol: CTBP1
  Gene Name: C-terminal binding protein 1
  ENSP ID: ENSP00000425053
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGL

SEQ ID NO: 20502 - protein, 202 aa, Homo sapiens
  Payload ID: 4141
  Gene Symbol: CTBP1
  Gene Name: C-terminal binding protein 1
  ENSP ID: ENSP00000426470
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGSPLLLTAVLVPPAFGESDVSGGLGEAATPR

SEQ ID NO: 20503 - protein, 69 aa, Homo sapiens
  Payload ID: 4141
  Gene Symbol: CTBP1
  Gene Name: C-terminal binding protein 1
  ENSP ID: ENSP00000487417
APSGGGHGVFPAHHQEVDTRFVLSPIRRWTLGLPCAPSGGGHSVYPEPHQEVDTRFALCPIRRWTLGFS

SEQ ID NO: 20504 - protein, 985 aa, Homo sapiens
  Payload ID: 4142
  Gene Symbol: CTBP2
  Gene Name: C-terminal binding protein 2
  Uniprot ID: P56545
  ENSP ID: ENSP00000311825
MPVPSRHINIGRSQSWDAAGWYEGPWENAESLRPLGRRSSLTYGTAEGTWFEPNHRPQDAALPVAAEPYLYREAVYNSVAARKGSTPDFTFYDSRQAVMSGRSPLLPREYYSDPSGAARVPKEPPLYRDPGVSRPVPSYGVLGSRTSWDPMQGRSPALQDAGHLYRDPGGKMIPQGRQTQSRAASPGRYGREQPDTRYGAEVPAYPLSQVFSDISERPIDPAPARQVAPTCLVVDPSSAAAPEGSTGVAPGALNRGYGPARESIPSKMAYETYEADLSTFQGPGGKRTVLPEFLAFLRAEGLAEATLGALLQQGFDSPAVLATLEDADIKSVAPNLGQARVLSRLANSCRTEMQLRRQDRGGPLPRARSSSFSHRSELLHGDLASLGAAAPLQTASPRAGDPARRPSSAPSQHLLETAATYSAPGVGTHAPHFPSNSGYSSPTPCALTARLSPTYPLQAGVALTNPGPSNPLHPGPRTAYSTAYTVPMELLKRERNVAASPLPSPHGSPQVLRKPGAPLGPSTLPPASQSLHTPHSPYQKVARRTGAPIIVSTMLAPEPSIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 20505 - protein, 445 aa, Homo sapiens
  Payload ID: 4142
  Gene Symbol: CTBP2
  Gene Name: C-terminal binding protein 2
  Uniprot ID: P56545
  ENSP ID: ENSP00000338615
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 20506 - protein, 513 aa, Homo sapiens
  Payload ID: 4142
  Gene Symbol: CTBP2
  Gene Name: C-terminal binding protein 2
  ENSP ID: ENSP00000357816
MRPGLPGPTGLCAQTSSRGQKSVLKQKESCGIWQLYHFLSRKQEPRWEPCVSGSSSGDGAVADLADELRGYPALCCTLPVHSYRSWAGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 20507 - protein, 445 aa, Homo sapiens; identical to SEQ ID NO: 20505
  Payload ID: 4142
  Gene Symbol: CTBP2
  Gene Name: C-terminal binding protein 2
  Uniprot ID: P56545
  ENSP ID: ENSP00000410474

SEQ ID NO: 20508 - protein, 3 aa, Homo sapiens
  Payload ID: 4142
  Gene Symbol: CTBP2
  Gene Name: C-terminal binding protein 2
  ENSP ID: ENSP00000434424
MAL

SEQ ID NO: 20509 - protein, 445 aa, Homo sapiens; identical to SEQ ID NO: 20505
  Payload ID: 4142
  Gene Symbol: CTBP2
  Gene Name: C-terminal binding protein 2
  Uniprot ID: P56545
  ENSP ID: ENSP00000434630

SEQ ID NO: 20510 - protein, 445 aa, Homo sapiens; identical to SEQ ID NO: 20505
  Payload ID: 4142
  Gene Symbol: CTBP2
  Gene Name: C-terminal binding protein 2
  Uniprot ID: P56545
  ENSP ID: ENSP00000436285

SEQ ID NO: 20511 - protein, 117 aa, Homo sapiens
  Payload ID: 4142
  Gene Symbol: CTBP2
  Gene Name: C-terminal binding protein 2
  ENSP ID: ENSP00000481909
  MOD_RES (1)..(1): Any amino acid
XGYDNVDIKAAGELGIAVCNIPSAAVEETADSTICHILNLYRRNTWLYQALREGTRVQSVEQIREVASGAARIRGETLGLIGFGWDRAVPGRAEGLHPAGFAVSERLRLLALQSQRT

SEQ ID NO: 20512 - protein, 591 aa, Homo sapiens
  Payload ID: 4143
  Gene Symbol: CTPS1
  Gene Name: CTP synthase 1
  Uniprot ID: P17812
  ENSP ID: ENSP00000361699
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 20513 - protein, 591 aa, Homo sapiens; identical to SEQ ID NO: 20512
  Payload ID: 4143
  Gene Symbol: CTPS1
  Gene Name: CTP synthase 1
  Uniprot ID: P17812
  ENSP ID: ENSP00000361704

SEQ ID NO: 20514 - protein, 586 aa, Homo sapiens
  Payload ID: 4144
  Gene Symbol: CTPS2
  Gene Name: CTP synthase 2
  Uniprot ID: Q9NRF8
  ENSP ID: ENSP00000352222
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPVLLEEQSIVKYFKERLHLPIGDSASNLLFKWRNMADRYERLQKICSIALVGKYTKLRDCYASVFKALEHSALAINHKLNLMYIDSIDLEKITETEDPVKFHEAWQKLCKADGILVPGGFGIRGTLGKLQAISWARTKKIPFLGVCLGMQLAVIEFARNCLNLKDADSTEFRPNAPVPLVIDMPEHNPGNLGGTMRLGIRRTVFKTENSILRKLYGDVPFIEERHRHRFEVNPNLIKQFEQNDLSFVGQDVDGDRMEIIELANHPYFVGVQFHPEFSSRPMKPSPPYLGLLLAATGNLNAYLQQGCKLSSSDRYSDASDDSFSEPRIAELEIS

SEQ ID NO: 20515 - protein, 586 aa, Homo sapiens; identical to SEQ ID NO: 20514
  Payload ID: 4144
  Gene Symbol: CTPS2
  Gene Name: CTP synthase 2
  Uniprot ID: Q9NRF8
  ENSP ID: ENSP00000369590

SEQ ID NO: 20516 - protein, 132 aa, Homo sapiens
  Payload ID: 4144
  Gene Symbol: CTPS2
  Gene Name: CTP synthase 2
  ENSP ID: ENSP00000400431
  MOD_RES (1)..(1): Any amino acid
XGKLQAISWARTKKIPFLGVCLGMQLAVIEFARNCLNLKDADSTEFRPNAPVPLVIDMPEHNPGNLGGTMRLGIRRTVFKTENSILISLSLGLASVEHTECPSAFDLRDSLFIGLFCELPMLLEMNLDWDLD

SEQ ID NO: 20517 - protein, 586 aa, Homo sapiens; identical to SEQ ID NO: 20514
  Payload ID: 4144
  Gene Symbol: CTPS2
  Gene Name: CTP synthase 2
  Uniprot ID: Q9NRF8
  ENSP ID: ENSP00000401264

SEQ ID NO: 20518 - protein, 1173 aa, Homo sapiens
  Payload ID: 4145
  Gene Symbol: CTR9
  Gene Name: CTR9 homolog, Paf1/RNA polymerase II complex component
  Uniprot ID: Q6PD62
  ENSP ID: ENSP00000355013
MSRGSIEIPLRDTDEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEADSIKNGVQLLSRAYTIDPSNPMVLNHLANHFFFKKDYSKVQHLALHAFHNTEVEAMQAESCYQLARSFHVQEDYDQAFQYYYQATQFASSSFVLPFFGLGQMYIYRGDKENASQCFEKVLKAYPNNYETMKILGSLYAASEDQEKRDIAKGHLKKVTEQYPDDVEAWIELAQILEQTDIQGALSAYGTATRILQEKVQADVPPEILNNVGALHFRLGNLGEAKKYFLASLDRAKAEAEHDEHYYNAISVTTSYNLARLYEAMCEFHEAEKLYKNILREHPNYVDCYLRLGAMARDKGNFYEASDWFKEALQINQDHPDAWSLIGNLHLAKQEWGPGQKKFERILKQPSTQSDTYSMLALGNVWLQTLHQPTRDREKEKRHQDRALAIYKQVLRNDAKNLYAANGIGAVLAHKGYFREARDVFAQVREATADISDVWLNLAHIYVEQKQYISAVQMYENCLRKFYKHQNTEVVLYLARALFKCGKLQECKQTLLKARHVAPSDTVLMFNVALVLQRLATSVLKDEKSNLKEVLNAVKELELAHRYFSYLSKVGDKMRFDLALAATEARQCSDLLSQAQYHVARARKQDEEERELRAKQEQEKELLRQKLLKEQEEKRLREKEEQKKLLEQRAQYVEKTKNILMFTGETEATKEKKRGGGGGRRSKKGGEFDEFVNDDTDDDLPISKKKKRRKGSGSEQEGEDEEGGERKKKKRRRHPKGEEGSDDDETENGPKPKKRRPPKAEKKKAPKPERLPPSMKGKIKSKAIISSSDDSSDEDKLKIADEGHPRNSNSNSDSDEDEQRKKCASSESDSDENQNKSGSEAGSPRRPRRQRSDQDSDSDQPSRKRRPSGSEQSDNESVQSGRSHSGVSENDSRPASPSAESDHESERGSDNEGSGQGSGNESEPEGSNNEASDRGSEHGSDDSD

SEQ ID NO: 20519 - protein, 300 aa, Homo sapiens
  Payload ID: 4145
  Gene Symbol: CTR9
  Gene Name: CTR9 homolog, Paf1/RNA polymerase II complex component
  ENSP ID: ENSP00000431458
DEVIELDFDQLPEGDEVISILKQEHTQLHIWIALALEYYKQGKTEEFVKLLEAARIDGNLDYRDHEKDQMTCLDTLAAYYVQQARKEKNKDNKKDLITQATLLYTMADKIIMYDQNHLLGRACFCLLEGDKMDQADAQFHFVLNQSPNNIPALLGKACISFNKKDYRGALAYYKKALRTNPGCPAEVRLGMGHCFVKLNKLEKARLAFSRALELNSKCVGALVGLAVLELNNKEDYSKVQHLALHAFHNTEVEAMQAESCYQLARSFHVQEDYDQAFQYYYQATQFASSSFVLPFFGLGQ

SEQ ID NO: 20520 - protein, 1217 aa, Homo sapiens
  Payload ID: 4146
  Gene Symbol: CTC1
  Gene Name: CTS telomere maintenance complex component 1
  Uniprot ID: Q2NKJ3
  ENSP ID: ENSP00000313759
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCELIDLDLSWLGHLFLFPRWSYLPPARWNSSGEGHLELWDAPVPVFPLTISPGPVTPIPVLYPESASCLLRLRNKLRGVQRNLAGSLVRLSALVKSKQKAYFILSLGRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLIAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISIPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 20521 - protein, 1031 aa, Homo sapiens
  Payload ID: 4146
  Gene Symbol: CTC1
  Gene Name: CTS telomere maintenance complex component 1
  Uniprot ID: Q2NKJ3
  ENSP ID: ENSP00000396018
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCELIDLDLSWLGHLFLFPRWSYLPPARWNSSGEGHLELWDAPVPVFPLTISPGPVTPIPVLYPESASCLLRLRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSSFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLIAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISIPLPHIYLAELLQGGQSPFQATASCHIVSVFSLQLFWVCAYCTSICRQAPGGGWDCRSRGDL

SEQ ID NO: 20522 - protein, 125 aa, Homo sapiens
  Payload ID: 4146
  Gene Symbol: CTC1
  Gene Name: CTS telomere maintenance complex component 1
  ENSP ID: ENSP00000462607
PHLDVYIEDPHLPPSLGLLPGARVHFSQLEKRVSRSHNVYCCFRSSTYVQVLSFPPETTISIPLPHIYLAELLQGGQSPFQATASCHIVSVFSLQLFWSSARVDEPMTMFLWTLCTSPSVLRPIV

SEQ ID NO: 20523 - protein, 123 aa, Homo sapiens
  Payload ID: 4146
  Gene Symbol: CTC1
  Gene Name: CTS telomere maintenance complex component 1
  ENSP ID: ENSP00000462720
  MOD_RES (1)..(1): Any amino acid
XGQSPFQATASCHIVSVFSLQLFWVCAYCTSICRQSSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 20524 - protein, 134 aa, Homo sapiens
  Payload ID: 4146
  Gene Symbol: CTC1
  Gene Name: CTS telomere maintenance complex component 1
  ENSP ID: ENSP00000463230
  MOD_RES (1)..(1): Any amino acid
XPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLIAPGPAFHRFLGVFLR

SEQ ID NO: 20525 - protein, 639 aa, Homo sapiens
  Payload ID: 4147
  Gene Symbol: CTTNBP2NL
  Gene Name: CTTNBP2 N-terminal like
  Uniprot ID: Q9P2B4
  ENSP ID: ENSP00000271277
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNLANTANPRGDTSHSPTPGKVSSPLSPLSPGIKSPTIPRAERGNPPPIPPKKPGLTPSPSATTPLTKTHSQAASLTTAEDLASSCSSNTVVANGKDVELLLPTSS

SEQ ID NO: 20526 - protein, 271 aa, Homo sapiens
  Payload ID: 4147
  Gene Symbol: CTTNBP2NL
  Gene Name: CTTNBP2 N-terminal like
  ENSP ID: ENSP00000390976
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLK

SEQ ID NO: 20527 - protein, 280 aa, Homo sapiens
  Payload ID: 4148
  Gene Symbol: CLEC1A
  Gene Name: C-type lectin domain family 1, member A
  Uniprot ID: Q8NC01
  ENSP ID: ENSP00000326407
MQAKYSSTRDMLDDDGDTTMSLHSQGSATTRHPEPRRTEHRAPSSTWRPVALTLLTLCLVLLIGLAALGLLFFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 20528 - protein, 70 aa, Homo sapiens
  Payload ID: 4148
  Gene Symbol: CLEC1A
  Gene Name: C-type lectin domain family 1, member A
  ENSP ID: ENSP00000396272
MQAKYSSTRDMLDDDGDTTMSLHSQGSATTRHPEPRRTEHRAPSSTWRPVALTLLTLCLVLLIGLAALGL

SEQ ID NO: 20529 - protein, 247 aa, Homo sapiens
  Payload ID: 4148
  Gene Symbol: CLEC1A
  Gene Name: C-type lectin domain family 1, member A
  ENSP ID: ENSP00000415048
MQAKYSSTRDMLDDDGDTTMSLHSQGSATTRHPEPRRTVFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 20530 - protein, 188 aa, Homo sapiens
  Payload ID: 4148
  Gene Symbol: CLEC1A
  Gene Name: C-type lectin domain family 1, member A
  ENSP ID: ENSP00000417010
MQAKYSSTRDMLDDDGDTTMSLHSQGSATTRHPEPRRTAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 20531 - protein, 66 aa, Homo sapiens
  Payload ID: 4148
  Gene Symbol: CLEC1A
  Gene Name: C-type lectin domain family 1, member A
  ENSP ID: ENSP00000438408
MQAKYSSTRDMLDDDGDTTMSLHSQGSATTRHPEPRRTGWSRVARSRLTAALTSLAQAILPPQPSE

SEQ ID NO: 20532 - protein, 229 aa, Homo sapiens
  Payload ID: 4149
  Gene Symbol: CLEC1B
  Gene Name: C-type lectin domain family 1, member B
  Uniprot ID: Q9P126
  ENSP ID: ENSP00000298527
MQDEDGYITLNIKTRKPALISVGSASSSWWRVMALILLILCVGMVVGLVALGIWSVMQRNYLQGENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 20533 - protein, 196 aa, Homo sapiens
  Payload ID: 4149
  Gene Symbol: CLEC1B
  Gene Name: C-type lectin domain family 1, member B
  Uniprot ID: Q9P126
  ENSP ID: ENSP00000327169
MQDEDGYITLNIKTRKPALISAVMQRNYLQGENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 20534 - protein, 96 aa, Homo sapiens
  Payload ID: 4149
  Gene Symbol: CLEC1B
  Gene Name: C-type lectin domain family 1, member B
  ENSP ID: ENSP00000381910
FKGHKCSPCDTNWRYYGDSCYGFFRHNLTWEESKQYCTDMNATLLKIDNRNIVEYIKARTHLIRWVGLSRQKSNEVWKWEDGSVISENMKTQIMIF

SEQ ID NO: 20535 - protein, 196 aa, Homo sapiens; identical to SEQ ID NO: 20533
  Payload ID: 4149
  Gene Symbol: CLEC1B
  Gene Name: C-type lectin domain family 1, member B
  Uniprot ID: Q9P126
  ENSP ID: ENSP00000406338

SEQ ID NO: 20536 - protein, 316 aa, Homo sapiens
  Payload ID: 4150
  Gene Symbol: CLEC10A
  Gene Name: C-type lectin domain family 10, member A
  Uniprot ID: Q8IUN9
  ENSP ID: ENSP00000254868
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAGVSELQEHTTQKAHLGHCPHCPSVCVPVHSEMLLRVQQLVQDLKKLTCQVATLNNNASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 20537 - protein, 289 aa, Homo sapiens
  Payload ID: 4150
  Gene Symbol: CLEC10A
  Gene Name: C-type lectin domain family 10, member A
  ENSP ID: ENSP00000414938
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAVHSEMLLRVQQLVQDLKKLTCQVATLNNNASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 20538 - protein, 256 aa, Homo sapiens
  Payload ID: 4150
  Gene Symbol: CLEC10A
  Gene Name: C-type lectin domain family 10, member A
  Uniprot ID: Q8IUN9
  ENSP ID: ENSP00000458728
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAVHSEMLLRVQQLVQDLKKLTCQVATLNNNASTEGTCCPVNWVEHQDSCYWFSHSGMSWAEAEKYCQLKNAHLVVINSREEQVRASGTQFLRHVPFREMVLKLGRTLESSGSFQNDCHLCHTLRDLIGLSIQRNISKLLS

SEQ ID NO: 20539 - protein, 292 aa, Homo sapiens
  Payload ID: 4150
  Gene Symbol: CLEC10A
  Gene Name: C-type lectin domain family 10, member A
  Uniprot ID: Q8IUN9
  ENSP ID: ENSP00000460252
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAVHSEMLLRVQQLVQDLKKLTCQVATLNNNGEEASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 20540 - protein, 136 aa, Homo sapiens
  Payload ID: 4150
  Gene Symbol: CLEC10A
  Gene Name: C-type lectin domain family 10, member A
  ENSP ID: ENSP00000461800
  MOD_RES (1)..(1): Any amino acid
XSSLEETIASLKAEVEGFKQERQAVHSEMLLRVQQLVQDLKKLTCQVATLNNNASTEGTCCPVNWVEHQDSCYWFSHSGMSWAEAEKYCQLKNAHLVVINSREEQELEARPARRLAGARAGWRRGLCSLPSRRQVE

SEQ ID NO: 20541 - protein, 323 aa, Homo sapiens
  Payload ID: 4151
  Gene Symbol: CLEC11A
  Gene Name: C-type lectin domain family 11, member A
  Uniprot ID: Q9Y240
  ENSP ID: ENSP00000250340
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFENGQRVSFFAWHRSPRPELGAQPSASPHPLSPDQPNGGTLENCVAQASDDGSWWDHDCQRRLYYVCEFPF

SEQ ID NO: 20542 - protein, 317 aa, Homo sapiens
  Payload ID: 4151
  Gene Symbol: CLEC11A
  Gene Name: C-type lectin domain family 11, member A
  ENSP ID: ENSP00000471075
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEDSECMTPPPSLPGPAHRLPEGAAPGPQVLPALARLRSSGGGAGAVHGAGREPGAAGRPPADGGAHSVPARGARSLQLARVAGRARSARRGPLPLRKRPARVLLRLASLTPPRARRPAQRLAASAQPGPAQRWHARELRGAGL

SEQ ID NO: 20543 - protein, 245 aa, Homo sapiens
  Payload ID: 4151
  Gene Symbol: CLEC11A
  Gene Name: C-type lectin domain family 11, member A
  ENSP ID: ENSP00000480599
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQPSASPHPLSPDQPNGGTLENCVAQASDDGSWWDHDCQRRLYYVCEFPF

SEQ ID NO: 20544 - protein, 265 aa, Homo sapiens
  Payload ID: 4152
  Gene Symbol: CLEC12A
  Gene Name: C-type lectin domain family 12, member A
  Uniprot ID: Q5QGZ9
  ENSP ID: ENSP00000302804
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 20545 - protein, 232 aa, Homo sapiens
  Payload ID: 4152
  Gene Symbol: CLEC12A
  Gene Name: C-type lectin domain family 12, member A
  Uniprot ID: Q5QGZ9
  ENSP ID: ENSP00000345448
MSEEVTYADLQFQNSSEMEKIPEIGKFGEKVHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 20546 - protein, 275 aa, Homo sapiens
  Payload ID: 4152
  Gene Symbol: CLEC12A
  Gene Name: C-type lectin domain family 12, member A
  Uniprot ID: Q5QGZ9
  ENSP ID: ENSP00000347916
MWIDFFTYSSMSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 20547 - protein, 165 aa, Homo sapiens
  Payload ID: 4152
  Gene Symbol: CLEC12A
  Gene Name: C-type lectin domain family 12, member A
  ENSP ID: ENSP00000379764
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQN

SEQ ID NO: 20548 - protein, 213 aa, Homo sapiens
  Payload ID: 4152
  Gene Symbol: CLEC12A
  Gene Name: C-type lectin domain family 12, member A
  Uniprot ID: Q5QGZ9
  ENSP ID: ENSP00000405244
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSA

SEQ ID NO: 20549 - protein, 276 aa, Homo sapiens
  Payload ID: 4153
  Gene Symbol: CLEC12B
  Gene Name: C-type lectin domain family 12, member B
  Uniprot ID: Q2HXU8
  ENSP ID: ENSP00000344563
MSEEVTYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSVLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLFSTKELDQINGSKGCAYFQKGNIYISRCSAEIFWICEKTAAPVKTEDLD

SEQ ID NO: 20550 - protein, 232 aa, Homo sapiens
  Payload ID: 4153
  Gene Symbol: CLEC12B
  Gene Name: C-type lectin domain family 12, member B
  Uniprot ID: Q2HXU8
  ENSP ID: ENSP00000379759
MSEEVTYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSVLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLYVSNY

SEQ ID NO: 20551 - protein, 232 aa, Homo sapiens; identical to SEQ ID NO: 20550
  Payload ID: 4153
  Gene Symbol: CLEC12B
  Gene Name: C-type lectin domain family 12, member B
  Uniprot ID: Q2HXU8
  ENSP ID: ENSP00000439561

SEQ ID NO: 20552 - protein, 65 aa, Homo sapiens
  Payload ID: 4153
  Gene Symbol: CLEC12B
  Gene Name: C-type lectin domain family 12, member B
  ENSP ID: ENSP00000444909
MSEEVTYATLTFQDSAGARNNRDGNNLRKRGHPAPSPIWRHAALGLVTLCLMLLIGLVTLGMMYI

SEQ ID NO: 20553 - protein, 490 aa, Homo sapiens
  Payload ID: 4154
  Gene Symbol: CLEC14A
  Gene Name: C-type lectin domain family 14, member A
  Uniprot ID: Q86T13
  ENSP ID: ENSP00000353013
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 20554 - protein, 152 aa, Homo sapiens
  Payload ID: 4155
  Gene Symbol: CLEC16A
  Gene Name: C-type lectin domain family 16, member A
  ENSP ID: ENSP00000261657
  MOD_RES (1)..(1): Any amino acid
XKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPAVRSGRKGRRRVFSLSEADSHGGHWV

SEQ ID NO: 20555 - protein, 906 aa, Homo sapiens
  Payload ID: 4155
  Gene Symbol: CLEC16A
  Gene Name: C-type lectin domain family 16, member A
  Uniprot ID: Q2KHT3
  ENSP ID: ENSP00000386495
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGEPAPRPAPQLVHHGGRSRSFSLWSLCELPFLSQKPRRLAAPAS

SEQ ID NO: 20556 - protein, 1053 aa, Homo sapiens
  Payload ID: 4155
  Gene Symbol: CLEC16A
  Gene Name: C-type lectin domain family 16, member A
  Uniprot ID: Q2KHT3
  ENSP ID: ENSP00000387122
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 20557 - protein, 128 aa, Homo sapiens
  Payload ID: 4155
  Gene Symbol: CLEC16A
  Gene Name: C-type lectin domain family 16, member A
  ENSP ID: ENSP00000389743
  MOD_RES (1)..(1): Any amino acid
XMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFQG

SEQ ID NO: 20558 - protein, 118 aa, Homo sapiens
  Payload ID: 4155
  Gene Symbol: CLEC16A
  Gene Name: C-type lectin domain family 16, member A
  ENSP ID: ENSP00000389963
LAKGRIQARRMKMQRIAALLDLPIQPTTEVLGFGLGSSTSTQHLPFRFYDQGRRGSSDPTVQRSVFASVDKVPALLTAAVERQPRWPLPSLLVPWLTDCCGGLCLLIYRRFSRIVFKI

SEQ ID NO: 20559 - protein, 265 aa, Homo sapiens
  Payload ID: 4156
  Gene Symbol: CLEC17A
  Gene Name: C-type lectin domain family 17, member A
  Uniprot ID: Q6ZS10
  ENSP ID: ENSP00000341620
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLEFCGQGPWLSTGVLAGAE

SEQ ID NO: 20560 - protein, 378 aa, Homo sapiens
  Payload ID: 4156
  Gene Symbol: CLEC17A
  Gene Name: C-type lectin domain family 17, member A
  Uniprot ID: Q6ZS10
  ENSP ID: ENSP00000393719
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHNFVAKAHGSPRVYWLGLNDRAQEGDWRWLDGSPVTLSFWEPEEPNNIHDEDCATMNKGGTWNDLSCYKTTYWICERKCSC

SEQ ID NO: 20561 - protein, 227 aa, Homo sapiens
  Payload ID: 4156
  Gene Symbol: CLEC17A
  Gene Name: C-type lectin domain family 17, member A
  ENSP ID: ENSP00000447424
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNIRGGWVGWVLSL

SEQ ID NO: 20562 - protein, 306 aa, Homo sapiens
  Payload ID: 4156
  Gene Symbol: CLEC17A
  Gene Name: C-type lectin domain family 17, member A
  Uniprot ID: Q6ZS10
  ENSP ID: ENSP00000450065
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHLLGARGTQ

SEQ ID NO: 20563 - protein, 446 aa, Homo sapiens
  Payload ID: 4157
  Gene Symbol: CLEC18A
  Gene Name: C-type lectin domain family 18, member A
  Uniprot ID: A5D8T8
  ENSP ID: ENSP00000288040
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 20564 - protein, 446 aa, Homo sapiens; identical to SEQ ID NO: 20563
  Payload ID: 4157
  Gene Symbol: CLEC18A
  Gene Name: C-type lectin domain family 18, member A
  Uniprot ID: A5D8T8
  ENSP ID: ENSP00000377304

SEQ ID NO: 20565 - protein, 455 aa, Homo sapiens
  Payload ID: 4157
  Gene Symbol: CLEC18A
  Gene Name: C-type lectin domain family 18, member A
  ENSP ID: ENSP00000413990
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 20566 - protein, 446 aa, Homo sapiens; identical to SEQ ID NO: 20563
  Payload ID: 4157
  Gene Symbol: CLEC18A
  Gene Name: C-type lectin domain family 18, member A
  Uniprot ID: A5D8T8
  ENSP ID: ENSP00000454685

SEQ ID NO: 20567 - protein, 66 aa, Homo sapiens
  Payload ID: 4157
  Gene Symbol: CLEC18A
  Gene Name: C-type lectin domain family 18, member A
  ENSP ID: ENSP00000454976
MRRLLVWATSSQLGCGRHLCSAGQAAIEAFVCAYSPRGNWEVNGKTIVPYKKGAWCSLCTASVSGC

SEQ ID NO: 20568 - protein, 299 aa, Homo sapiens
  Payload ID: 4157
  Gene Symbol: CLEC18A
  Gene Name: C-type lectin domain family 18, member A
  ENSP ID: ENSP00000478435
MLHPETSPGRGHLLAVLLALLGTAWAEVWPPQLQEQAPMAGALNRKESFLLLSLHNRLRSWVQPPAADMRRLDWSDSLAQLAQGSPLWNPNPEPGVRPVAHPASGLEHAAAPRAWCPLSKWSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYEPSVPPRCIFPSTPVT

SEQ ID NO: 20569 - protein, 303 aa, Homo sapiens
  Payload ID: 4157
  Gene Symbol: CLEC18A
  Gene Name: C-type lectin domain family 18, member A
  ENSP ID: ENSP00000483531
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGEPSVPPRCIFPSTPVT

SEQ ID NO: 20570 - protein, 446 aa, Homo sapiens; identical to SEQ ID NO: 20563
  Payload ID: 4157
  Gene Symbol: CLEC18A
  Gene Name: C-type lectin domain family 18, member A
  Uniprot ID: A5D8T8
  ENSP ID: ENSP00000484176

SEQ ID NO: 20571 - protein, 455 aa, Homo sapiens
  Payload ID: 4158
  Gene Symbol: CLEC18B
  Gene Name: C-type lectin domain family 18, member B
  Uniprot ID: Q6UXF7
  ENSP ID: ENSP00000341051
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 20572 - protein, 303 aa, Homo sapiens [sequence omitted]

SEQ ID NO: 20573 - protein, 446 aa, Homo sapiens
  Payload ID: 4158
  Gene Symbol: CLEC18B
  Gene Name: C-type lectin domain family 18, member B
  ENSP ID: ENSP00000482974
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPRGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 20574 - protein, 446 aa, Homo sapiens; identical to SEQ ID NO: 20573
  Payload ID: 4158
  Gene Symbol: CLEC18B
  Gene Name: C-type lectin domain family 18, member B
  ENSP ID: ENSP00000483587

SEQ ID NO: 20575 - protein, 446 aa, Homo sapiens
  Payload ID: 4159
  Gene Symbol: CLEC18C
  Gene Name: C-type lectin domain family 18, member C
  Uniprot ID: Q8NCF0
  ENSP ID: ENSP00000326538
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNNQRCKTRNRYICQFAQEHISRWGPGS

SEQ ID NO: 20576 - protein, 455 aa, Homo sapiens
  Payload ID: 4159
  Gene Symbol: CLEC18C
  Gene Name: C-type lectin domain family 18, member C
  ENSP ID: ENSP00000444726
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNNQRCKTRNRYICQFAQEHISRWGPGS

SEQ ID NO: 20577 - protein, 446 aa, Homo sapiens; identical to SEQ ID NO: 20575
  Payload ID: 4159
  Gene Symbol: CLEC18C
  Gene Name: C-type lectin domain family 18, member C
  Uniprot ID: Q8NCF0
  ENSP ID: ENSP00000444875

SEQ ID NO: 20578 - protein, 446 aa, Homo sapiens; identical to SEQ ID NO: 20575
  Payload ID: 4159
  Gene Symbol: CLEC18C
  Gene Name: C-type lectin domain family 18, member C
  Uniprot ID: Q8NCF0
  ENSP ID: ENSP00000455920

SEQ ID NO: 20579 - protein, 134 aa, Homo sapiens
  Payload ID: 4159
  Gene Symbol: CLEC18C
  Gene Name: C-type lectin domain family 18, member C
  ENSP ID: ENSP00000456676
MLHPETSPGRGHLLAVLLALLGTAWAEVWPPQLQEQAPMAGALNRKESFLLLSLHNRLRSWVQPPAADMRRLLVWATSSQLGCGRHLCSAGQAAIEAFVCAYSPRGNWEVNGKTIVPYKKGAWCSLCTASVSGC

SEQ ID NO: 20580 - protein, 119 aa, Homo sapiens
  Payload ID: 4159
  Gene Symbol: CLEC18C
  Gene Name: C-type lectin domain family 18, member C
  ENSP ID: ENSP00000457584
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLAS

SEQ ID NO: 20581 - protein, 446 aa, Homo sapiens; identical to SEQ ID NO: 20575
  Payload ID: 4159
  Gene Symbol: CLEC18C
  Gene Name: C-type lectin domain family 18, member C
  Uniprot ID: Q8NCF0
  ENSP ID: ENSP00000477846

SEQ ID NO: 20582 - protein, 302 aa, Homo sapiens
  Payload ID: 4159
  Gene Symbol: CLEC18C
  Gene Name: C-type lectin domain family 18, member C
  ENSP ID: ENSP00000478195
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYEPSVPPRCIFPSTPVT

SEQ ID NO: 20583 - protein, 301 aa, Homo sapiens
  Payload ID: 4159
  Gene Symbol: CLEC18C
  Gene Name: C-type lectin domain family 18, member C
  ENSP ID: ENSP00000478937
MLHPETSPGRGHLLAVLLALLGTAWAEVWPPQLQEQAPMAGALNRKESFLLLSLHNRLRSWVQPPAADMRRLDWSDSLANWLKPGSPLWNPNPEPGVRPVAHPASGLEHAACPRAWRPLLKWSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGEPSVPPRCIFPSTPVT

SEQ ID NO: 20584 - protein, 136 aa, Homo sapiens
  Payload ID: 4160
  Gene Symbol: CLEC19A
  Gene Name: C-type lectin domain family 19, member A
  Uniprot ID: Q6UXS0
  ENSP ID: ENSP00000455948
MQRWTLWAAAFLTLHSAQAFPQTDISISPALPELPLPSLCPLFWMEFKGHCYRFFPLNKTWAEADLYCSEFSVGRKSAKLASIHSWEENVFVYDLVNSCVPGIPADVWTGLHDHRQVRKQWPLGPLGSSSQDSILI

SEQ ID NO: 20585 - protein, 65 aa, Homo sapiens
  Payload ID: 4160
  Gene Symbol: CLEC19A
  Gene Name: C-type lectin domain family 19, member A
  ENSP ID: ENSP00000455961
MQRWTLWAAAFLTLHSAQAFPQTDISISPVCFLSAPSPARAAPAFPVPPVLDGVQRPLLSILPSQ

SEQ ID NO: 20586 - protein, 86 aa, Homo sapiens
  Payload ID: 4160
  Gene Symbol: CLEC19A
  Gene Name: C-type lectin domain family 19, member A
  ENSP ID: ENSP00000455985
MQRWTLWAAAFLTLHSAQAFPQTDISISPALPELPLPSLCPLFWMEFKGHCYRFFPLNKTWAEADLYCSEFSVGRKSAKLASIHSL

SEQ ID NO: 20587 - protein, 160 aa, Homo sapiens
  Payload ID: 4161
  Gene Symbol: CLEC2A
  Gene Name: C-type lectin domain family 2, member A
  Uniprot ID: Q6UVW9
  ENSP ID: ENSP00000339732
MINPELRDGRADGFIHRIVPKLIQNWKIGLMCFLSIIITTVCIIMIATWSKHAKPVACSGDWLGVRDKCFYFSDDTRNWTASKIFCSLQKAELAQIDTQEDMEFLKRYAGTDMHWIGLSRKQGDSWKWTNGTTFNGWPSNSKWSCNWSLRQWLLLLGPLR

SEQ ID NO: 20588 - protein, 174 aa, Homo sapiens
  Payload ID: 4161
  Gene Symbol: CLEC2A
  Gene Name: C-type lectin domain family 2, member A
  Uniprot ID: Q6UVW9
  ENSP ID: ENSP00000396163
MINPELRDGRADGFIHRIVPKLIQNWKIGLMCFLSIIITTVCIIMIATWSKHAKPVACSGDWLGVRDKCFYFSDDTRNWTASKIFCSLQKAELAQIDTQEDMEFLKRYAGTDMHWIGLSRKQGDSWKWTNGTTFNGWFEIIGNGSFAFLSADGVHSSRGFIDIKWICSKPKYFL

SEQ ID NO: 20589 - protein, 149 aa, Homo sapiens
  Payload ID: 4162
  Gene Symbol: CLEC2B
  Gene Name: C-type lectin domain family 2, member B
  Uniprot ID: Q92478
  ENSP ID: ENSP00000228438
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 20590 - protein, 80 aa, Homo sapiens
  Payload ID: 4162
  Gene Symbol: CLEC2B
  Gene Name: C-type lectin domain family 2, member B
  ENSP ID: ENSP00000437946
MILKLILSLKNFLRRYKCSSDHWIGLKMAKNRTGQWVDGATFTKSFGMRGSEGCAYLSDDGAATARCYTERKWICRKRIH

SEQ ID NO: 20591 - protein, 154 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000261339
MHDSNNVEKDITPSELPANPAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 20592 - protein, 194 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000261340
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 20593 - protein, 191 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000290855
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 20594 - protein, 122 aa, Homo sapiens
  Payload ID: 4163
  Gene Symbol: CLEC2D
  Gene Name: C-type lectin domain family 2, member D
  ENSP ID: ENSP00000371409
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELVRK

SEQ ID NO: 20595 - protein, 122 aa, Homo sapiens; identical to SEQ ID NO: 20594
  Payload ID: 4163
  Gene Symbol: CLEC2D
  Gene Name: C-type lectin domain family 2, member D
  ENSP ID: ENSP00000399744

SEQ ID NO: 20596 - protein, 173 aa, Homo sapiens
  Payload ID: 4163
  Gene Symbol: CLEC2D
  Gene Name: C-type lectin domain family 2, member D
  ENSP ID: ENSP00000413045
CLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 20597 - protein, 106 aa, Homo sapiens
  Payload ID: 4163
  Gene Symbol: CLEC2D
  Gene Name: C-type lectin domain family 2, member D
  ENSP ID: ENSP00000437861
EHSIKATLIWRLFFLIMFLTIIVCGMVAALSAIRANCHQEPSVCLQAACPESWIGFQRKCFYFSDDTKNWTSSQRFCDSQDADLAQVESFQELVSYPGSRRVCLFE

SEQ ID NO: 20598 - protein, 80 aa, Homo sapiens
  Payload ID: 4163
  Gene Symbol: CLEC2D
  Gene Name: C-type lectin domain family 2, member D
  ENSP ID: ENSP00000438735
MFLTIIVCGMVAALSAIRANCHQEPSVCLQAACPESWIGFQRKCFYFSDDTKNWTSSQRFCDSQDADLAQVESFQELVRK

SEQ ID NO: 20599 - protein, 154 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000441653
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQ

SEQ ID NO: 20600 - protein, 132 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000443065
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELVSYPGSRRVCLFE

SEQ ID NO: 20601 - protein, 54 aa, Homo sapiens
  Payload ID: 4163
  Gene Symbol: CLEC2D
  Gene Name: C-type lectin domain family 2, member D
  ENSP ID: ENSP00000443110
MHDSNNVEKDITPSELPANPGTSVSCCHVKKNTFASSSTIIVVCIQKSILLKLP

SEQ ID NO: 20602 - protein, 133 aa, Homo sapiens
  Payload ID: 4163
  Gene Symbol: CLEC2D
  Gene Name: C-type lectin domain family 2, member D
  ENSP ID: ENSP00000443177
AIRANCHQEPSVCLQAACPESWIGFQRKCFYFSDDTKNWTSSQRFCDSQDADLAQVESFQELNFLLRYKGPSDHWIGLSREQGQPWKWINGTEWTRQDRVLLCYPGWSAVVPSWLTAALTSLAQVSLPSQPPE

SEQ ID NO: 20603 - protein, 80 aa, Homo sapiens; identical to SEQ ID NO: 20598
  Payload ID: 4163
  Gene Symbol: CLEC2D
  Gene Name: C-type lectin domain family 2, member D
  ENSP ID: ENSP00000443627

SEQ ID NO: 20604 - protein, 95 aa, Homo sapiens
  Payload ID: 4163
  Gene Symbol: CLEC2D
  Gene Name: C-type lectin domain family 2, member D
  Uniprot ID: Q9UHP7
  ENSP ID: ENSP00000444818
MHDSNNVEKDITPSELPANPAIRANCHQEPSVCLQAACPESWIGFQRKCFYFSDDTKNWTSSQRFCDSQDADLAQVESFQELVSYPGSRRVCLFE

SEQ ID NO: 20605 - protein, 140 aa, Homo sapiens
  Payload ID: 4163
  Gene Symbol: CLEC2D
  Gene Name: C-type lectin domain family 2, member D
  ENSP ID: ENSP00000446028
VEKDITPSELPANPAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVR

SEQ ID NO: 20606 - protein, 214 aa, Homo sapiens
  Payload ID: 4164
  Gene Symbol: CLEC2L
  Gene Name: C-type lectin domain family 2, member L
  Uniprot ID: P0C7M8
  ENSP ID: ENSP00000390661
MEPAREPPSRARPPPPLAARPAPAPAAPRPRSPAEAEARGPEGLLRRSGSGYEGSTSWKAALEDTTTRLLLGAIAVLLFAILVVMSILASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGPGECVFVEPTRLVSTECLMTRPWVCSKMAYT

SEQ ID NO: 20607 - protein, 108 aa, Homo sapiens
  Payload ID: 4164
  Gene Symbol: CLEC2L
  Gene Name: C-type lectin domain family 2, member L
  ENSP ID: ENSP00000428508
  MOD_RES (1)..(1): Any amino acid
XEGSTSWKAALEASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGP

SEQ ID NO: 20608 - protein, 206 aa, Homo sapiens
  Payload ID: 4165
  Gene Symbol: CLEC3A
  Gene Name: C-type lectin domain family 3, member A
  ENSP ID: ENSP00000299642
MAQQACPRAMAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 20609 - protein, 50 aa, Homo sapiens
  Payload ID: 4165
  Gene Symbol: CLEC3A
  Gene Name: C-type lectin domain family 3, member A
  ENSP ID: ENSP00000457211
MAQQACPRAMAKNGLVICILVITLLLDQTTSHTSRLKARKHSKRRVRGIC

SEQ ID NO: 20610 - protein, 202 aa, Homo sapiens
  Payload ID: 4166
  Gene Symbol: CLEC3B
  Gene Name: C-type lectin domain family 3, member B
  Uniprot ID: P05452
  ENSP ID: ENSP00000296130
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 20611 - protein, 160 aa, Homo sapiens
  Payload ID: 4166
  Gene Symbol: CLEC3B
  Gene Name: C-type lectin domain family 3, member B
  ENSP ID: ENSP00000396013
MFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 20612 - protein, 237 aa, Homo sapiens
  Payload ID: 4167
  Gene Symbol: CLEC4A
  Gene Name: C-type lectin domain family 4, member A
  Uniprot ID: Q9UMR7
  ENSP ID: ENSP00000229332
MTSEITYAEVRFKNEFKSSGINTASSAASKERTAPHKSNTGFPKLLCASLLIFFLLLAISFFIAFVIFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 20613 - protein, 204 aa, Homo sapiens
  Payload ID: 4167
  Gene Symbol: CLEC4A
  Gene Name: C-type lectin domain family 4, member A
  Uniprot ID: Q9UMR7
  ENSP ID: ENSP00000247243
MTSEITYAEVRFKNEFKSSGINTASSAASKERTAPHKSNTGFPKLLCASLLIFFLLLAISFFIAFVKTAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 20614 - protein, 165 aa, Homo sapiens
  Payload ID: 4167
  Gene Symbol: CLEC4A
  Gene Name: C-type lectin domain family 4, member A
  Uniprot ID: Q9UMR7
  ENSP ID: ENSP00000344646
MTSEITYAEVRFKNEFKSSGINTASSAETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 20615 - protein, 198 aa, Homo sapiens
  Payload ID: 4167
  Gene Symbol: CLEC4A
  Gene Name: C-type lectin domain family 4, member A
  Uniprot ID: Q9UMR7
  ENSP ID: ENSP00000353690
MTSEITYAEVRFKNEFKSSGINTASSAVFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 20616 - protein, 84 aa, Homo sapiens
  Payload ID: 4167
  Gene Symbol: CLEC4A
  Gene Name: C-type lectin domain family 4, member A
  ENSP ID: ENSP00000443082
FKNEFKSSGINTASSAASKERTAPHKSNTGFPKLLCASLLIFFLLLAISFFIAFVRFHLPESARRICLFCGALRSRRSATLAMG

SEQ ID NO: 20617 - protein, 182 aa, Homo sapiens
  Payload ID: 4168
  Gene Symbol: CLEC4C
  Gene Name: C-type lectin domain family 4, member C
  Uniprot ID: Q8WTT0
  ENSP ID: ENSP00000346648
MVPEEEPQDRVPHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 20618 - protein, 213 aa, Homo sapiens
  Payload ID: 4168
  Gene Symbol: CLEC4C
  Gene Name: C-type lectin domain family 4, member C
  Uniprot ID: Q8WTT0
  ENSP ID: ENSP00000353500
MVPEEEPQDREKGLWWFQLKVWSMAVVSILLLSVCFTVSSVVPHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 20619 - protein, 88 aa, Homo sapiens
  Payload ID: 4168
  Gene Symbol: CLEC4C
  Gene Name: C-type lectin domain family 4, member C
  ENSP ID: ENSP00000438649
DWSCCPTPWTSFQSSCYFISTGMQSWTKSQKNCSVMGADLVVINTREEQDFIIQNLKRNSSYFLGLSDPGGRRHWQWVDQTPYNENVT

SEQ ID NO: 20620 - protein, 213 aa, Homo sapiens; identical to SEQ ID NO: 20618
  Payload ID: 4168
  Gene Symbol: CLEC4C
  Gene Name: C-type lectin domain family 4, member C
  Uniprot ID: Q8WTT0
  ENSP ID: ENSP00000440428

SEQ ID NO: 20621 - protein, 138 aa, Homo sapiens
  Payload ID: 4168
  Gene Symbol: CLEC4C
  Gene Name: C-type lectin domain family 4, member C
  ENSP ID: ENSP00000442457
EEEPQDREKGLWWFQLKVWSMAVVSILLLSVCFTVSSVDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDE

SEQ ID NO: 20622 - protein, 182 aa, Homo sapiens; identical to SEQ ID NO: 20617
  Payload ID: 4168
  Gene Symbol: CLEC4C
  Gene Name: C-type lectin domain family 4, member C
  Uniprot ID: Q8WTT0
  ENSP ID: ENSP00000445338

SEQ ID NO: 20623 - protein, 215 aa, Homo sapiens
  Payload ID: 4169
  Gene Symbol: CLEC4D
  Gene Name: C-type lectin domain family 4, member D
  Uniprot ID: Q8WXI8
  ENSP ID: ENSP00000299665
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLGLRDENAKGQWRWVDQTPFNPRRVFWHKNEPDNSQGENCVVLVYNQDKWAWNDVPCNFEASRICKIPGTTLN

SEQ ID NO: 20624 - protein, 144 aa, Homo sapiens
  Payload ID: 4169
  Gene Symbol: CLEC4D
  Gene Name: C-type lectin domain family 4, member D
  ENSP ID: ENSP00000371496
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLG

SEQ ID NO: 20625 - protein, 219 aa, Homo sapiens
  Payload ID: 4170
  Gene Symbol: CLEC4E
  Gene Name: C-type lectin domain family 4, member E
  Uniprot ID: Q9ULY5
  ENSP ID: ENSP00000299663
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 20626 - protein, 92 aa, Homo sapiens
  Payload ID: 4170
  Gene Symbol: CLEC4E
  Gene Name: C-type lectin domain family 4, member E
  ENSP ID: ENSP00000387737
MNSSKSSETQCTERGCFSSQMFLWTVAGIPILFLSACFITRCVVTFRIFQTCDEKKFQLPENFTELSCYNYGSGIIVPKVNIKIYKATFSGF

SEQ ID NO: 20627 - protein, 92 aa, Homo sapiens; identical to SEQ ID NO: 20626
  Payload ID: 4170
  Gene Symbol: CLEC4E
  Gene Name: C-type lectin domain family 4, member E
  ENSP ID: ENSP00000404994

SEQ ID NO: 20628 - protein, 174 aa, Homo sapiens
  Payload ID: 4170
  Gene Symbol: CLEC4E
  Gene Name: C-type lectin domain family 4, member E
  ENSP ID: ENSP00000443034
MNSSKSSETQCTERGCFSSQMFLWTVAGIPILFLSACFITRCVVTFRIFQTCDEKKFQLPENFTELSCYNYGSGIIVPKEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 20629 - protein, 94 aa, Homo sapiens
  Payload ID: 4170
  Gene Symbol: CLEC4E
  Gene Name: C-type lectin domain family 4, member E
  ENSP ID: ENSP00000443328
  MOD_RES (1)..(1): Any amino acid
XNFTELSCYNYGSGSVKNCCPLNWEYFQSSCYFFSTDTISWALSLKNCSAMGAHLVVINSQEEQLLGCRGAQQHSYPGGLCHHERLFKPKAKLE

SEQ ID NO: 20630 - protein, 589 aa, Homo sapiens
  Payload ID: 4171
  Gene Symbol: CLEC4F
  Gene Name: C-type lectin domain family 4, member F
  Uniprot ID: Q8N1N0
  ENSP ID: ENSP00000272367
MDGEAVRFCTDNQCVSLHPQEVDSVAMAPAAPKIPRLVQATPAFMAVTLVFSLVTLFVVVQQQTRPVPKPVQAVILGDNITGHLPFEPNNHHHFGREAEMRELIQTFKGHMENSSAWVVEIQMLKCRVDNVNSQLQVLGDHLGNTNADIQMVKGVLKDATTLSLQTQMLRSSLEGTNAEIQRLKEDLEKADALTFQTLNFLKSSLENTSIELHVLSRGLENANSEIQMLNASLETANTQAQLANSSLKNANAEIYVLRGHLDSVNDLRTQNQVLRNSLEGANAEIQGLKENLQNTNALNSQTQAFIKSSFDNTSAEIQFLRGHLERAGDEIHVLKRDLKMVTAQTQKANGRLDQTDTQIQVFKSEMENVNTLNAQIQVLNGHMKNASREIQTLKQGMKNASALTSQTQMLDSNLQKASAEIQRLRGDLENTKALTMEIQQEQSRLKTLHVVITSQEQLQRTQSQLLQMVLQGWKFNGGSLYYFSSVKKSWHEAEQFCVSQGAHLASVASKEEQAFLVEFTSKVYYWIGLTDRGTEGSWRWTDGTPFNAAQNKAPGSKGSCPLRKYIIVNSGMGACSFIDTPPCPWILSN

SEQ ID NO: 20631 - protein, 567 aa, Homo sapiens
  Payload ID: 4171
  Gene Symbol: CLEC4F
  Gene Name: C-type lectin domain family 4, member F
  Uniprot ID: Q8N1N0
  ENSP ID: ENSP00000390581
MDGEAVRFCTDNQCVSLHPQEVDSVAMAPAAPKIPRLVQATPAFMAVTLVFSLVTLFVVVQQQTRPVPKPVQAVILGDNITGHLPFEPNNHHHFGREAEMRELIQTFKGHMENSSAWVVEIQMLKCRVDNVNSQLQVLGDHLGNTNADIQMVKGVLKDATTLSLQTQMLRSSLEGTNAEIQRLKEDLEKADALTFQTLNFLKSSLENTSIELHVLSRGLENANSEIQMLNASLETANTQAQLANSSLKNANAEIYVLRGHLDSVNDLRTQNQVLRNSLEGANAEIQGLKENLQNTNALNSQTQAFIKSSFDNTSAEIQFLRGHLERAGDEIHVLKRDLKMVTAQTQKANGRLDQTDTQIQVFKSEMENVNTLNAQIQVLNGHMKNASREIQTLKQGMKNASALTSQTQMLDSNLQKASAEIQRLRGDLENTKALTMEIQQEQSRLKTLHVVITSQEQLQRTQSQLLQMVLQGWKFNGGSLYYFSSVKKSWHEAEQFCVSQGAHLASVASKEEQAFLVEFTSKVYYWIGLTDRGTEGSWRWTDGTPFNAAQNKASHSTRKGCCLHLTV

SEQ ID NO: 20632 - protein, 293 aa, Homo sapiens
  Payload ID: 4172
  Gene Symbol: CLEC4G
  Gene Name: C-type lectin domain family 4, member G
  Uniprot ID: Q6UXB4
  ENSP ID: ENSP00000327599
MDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 20633 - protein, 149 aa, Homo sapiens
  Payload ID: 4172
  Gene Symbol: CLEC4G
  Gene Name: C-type lectin domain family 4, member G
  ENSP ID: ENSP00000472374
MPRNEGLVILPRLVWSGTPGLSDPSMSASQSAGITGLGACIAMDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRA

SEQ ID NO: 20634 - protein, 252 aa, Homo sapiens
  Payload ID: 4172
  Gene Symbol: CLEC4G
  Gene Name: C-type lectin domain family 4, member G
  ENSP ID: ENSP00000483109
MEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHLLTPPSALEPRPLQHVVSWGLLTSLAPGADCQRVFSSSSTAAESQKHLAQHSPVQPSAWALGPPCRPHPNSTHADPT

SEQ ID NO: 20635 - protein, 376 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000248228
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20636 - protein, 399 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000316228
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20637 - protein, 348 aa, Homo sapiens
  Payload ID: 4173
  Gene Symbol: CLEC4M
  Gene Name: C-type lectin domain family 4, member M
  ENSP ID: ENSP00000335228
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20638 - protein, 332 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000351954
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTELKAAVGELPEKSKLQEIYQELTQLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20639 - protein, 387 aa, Homo sapiens
  Payload ID: 4173
  Gene Symbol: CLEC4M
  Gene Name: C-type lectin domain family 4, member M
  ENSP ID: ENSP00000377680
MSDSKEPRVQQLGLLEEDPTTNFQFQQIHGHKSSTGCLGHGALVLQLLSFMLLAGVLPRLSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20640 - protein, 263 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000470132
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20641 - protein, 332 aa, Homo sapiens
  Payload ID: 4173
  Gene Symbol: CLEC4M
  Gene Name: C-type lectin domain family 4, member M
  ENSP ID: ENSP00000470137
MSDSKEPRVQQLGLLEEDPTTSGIRLFPRDFQFQQIHGHKSSTVPFLLGPVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 20642 - protein, 282 aa, Homo sapiens
  Payload ID: 4173
  Gene Symbol: CLEC4M
  Gene Name: C-type lectin domain family 4, member M
  ENSP ID: ENSP00000470286
MSDSKEPRVQQLGLLEEDPTTSGIRLFPRDFQFQQIHGHKSSTVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAE

SEQ ID NO: 20643 - protein, 296 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000471125
MSDSKEPRVQQLGLLGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQLPAVLEQWRTQQ

SEQ ID NO: 20644 - protein, 232 aa, Homo sapiens
  Payload ID: 4173
  Gene Symbol: CLEC4M
  Gene Name: C-type lectin domain family 4, member M
  Uniprot ID: Q9H2X3
  ENSP ID: ENSP00000471132
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVERLCRHCPKDWTFFQGNCYFMSNSQRNWHDSVTACQEVRAQLVVIKTAEEQLPAVLEQWRTQQ

SEQ ID NO: 20645 - protein, 53 aa, Homo sapiens
  Payload ID: 4174
  Gene Symbol: CLEC5A
  Gene Name: C-type lectin domain family 5, member A
  ENSP ID: ENSP00000392561
MNWHMIISGLIVVVLKVVGMTLFLLYFPQIFNKSNDGFTTTRSYGTEVSSGHN

SEQ ID NO: 20646 - protein, 84 aa, Homo sapiens
  Payload ID: 4174
  Gene Symbol: CLEC5A
  Gene Name: C-type lectin domain family 5, member A
  ENSP ID: ENSP00000395258
MVSPPPGAMEQKFLQDITDAEKYFIGLIYHREEKRWRWINNSVFNGNVTNQNQNFNCATIGLTKTFDAASCDISYRRICEKNAK

SEQ ID NO: 20647 - protein, 155 aa, Homo sapiens
  Payload ID: 4174
  Gene Symbol: CLEC5A
  Gene Name: C-type lectin domain family 5, member A
  ENSP ID: ENSP00000414897
MNWHMIISGLIVVVLKVVGMTLFLLYFPQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGKYVNMPQFPGDLGLLQKTKPEIAGFTLE

SEQ ID NO: 20648 - protein, 165 aa, Homo sapiens
  Payload ID: 4174
  Gene Symbol: CLEC5A
  Gene Name: C-type lectin domain family 5, member A
  ENSP ID: ENSP00000446890
MNWHMIISGLIVVVLKVVGMTLFLLYFPQIFNKSNDGFTTTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 20649 - protein, 188 aa, Homo sapiens
  Payload ID: 4174
  Gene Symbol: CLEC5A
  Gene Name: C-type lectin domain family 5, member A
  Uniprot ID: Q9NY25
  ENSP ID: ENSP00000449999
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 20650 - protein, 209 aa, Homo sapiens
  Payload ID: 4175
  Gene Symbol: CLEC6A
  Gene Name: C-type lectin domain family 6, member A
  Uniprot ID: Q6EIG7
  ENSP ID: ENSP00000371505
MMQEQQPQSTEKRGWLSLRLWSVAGISIALLSACFIVSCVVTYHFTYGETGKRLSELHSYHSSLTCFSEGTKVPAWGCCPASWKSFGSSCYFISSEEKVWSKSEQNCVEMGAHLVVFNTEAEQNFIVQQLNESFSYFLGLSDPQGNNNWQWIDKTPYEKNVRFWHLGEPNHSAEQCASIVFWKPTGWGWNDVICETRRNSICEMNKIYL

SEQ ID NO: 20651 - protein, 201 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000266456
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 20652 - protein, 143 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000298523
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELISDQNHSYPRKPISKLCMDSRVSHL

SEQ ID NO: 20653 - protein, 247 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000302569
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 20654 - protein, 77 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000312089
MEYHPDLENLDEDGYTQLHFDSQSNTRIAVVSEKGSCAASPPWRLIAVILGILCLVILVIAVVLGTMAGFKAVEFKG

SEQ ID NO: 20655 - protein, 45 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000344723
MEYHPDLENLDEDGYTQLHFDSQSNTRIAVVSEKGIYSKTSVFPT

SEQ ID NO: 20656 - protein, 168 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000379743
MEYHPDLENLDEDGYTQLHFDSQSNTRIAVVSEKGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 20657 - protein, 189 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000431461
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELISDQNHSYPRKPISKLCMDSRVSHL

SEQ ID NO: 20658 - protein, 247 aa, Homo sapiens; identical to SEQ ID NO: 20653
  Payload ID: 4176
  Gene Symbol: CLEC7A
  Gene Name: C-type lectin domain family 7, member A
  Uniprot ID: Q9BXN2
  ENSP ID: ENSP00000432876

SEQ ID NO: 20659 - protein, 192 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000434392
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELSLTLLPKLECSEAATSQAQVILPPQLPE

SEQ ID NO: 20660 - protein, 136 aa, Homo sapiens
  Payload ID: 4176
  Gene Symbol: CLEC7A
  Gene Name: C-type lectin domain family 7, member A
  ENSP ID: ENSP00000434954
MEYHPDLENLDEDGYTQLHFDSQSNTRIAVVSEKGSCAASPPWRLIAVILGILCLVILVIAVVLGTMGEYLVEEINNRQFSKQLLCARHSFKGLTCIIYFNLYIIWFYLYWVGAVNAHFTYKGCERLRGYFTFPGL

SEQ ID NO: 20661 - protein, 116 aa, Homo sapiens
  Payload ID: 4176
  Gene Symbol: CLEC7A
  Gene Name: C-type lectin domain family 7, member A
  Uniprot ID: Q9BXN2
  ENSP ID: ENSP00000436923
MEYHPDLENLDEDGYTQLHFDSQSNTRIAVVSEKGSCAASPPWRLIAVILGILCLVILVIAVVLGTMGTGQFLKDLSFLNNRRKLFGDPIQEATHWRMATFYQEIKRTTVNPHNHL

SEQ ID NO: 20662 - protein, 241 aa, Homo sapiens
  Payload ID: 4177
  Gene Symbol: CLEC9A
  Gene Name: C-type lectin domain family 9, member A
  Uniprot ID: Q6UXN8
  ENSP ID: ENSP00000348074
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 20663 - protein, 167 aa, Homo sapiens
  Payload ID: 4178
  Gene Symbol: CLECL1
  Gene Name: C-type lectin-like 1
  Uniprot ID: Q8IZS7
  ENSP ID: ENSP00000331766
MVSNFFHVIQVFEKSATLISKTEHIGFVIYSWRKSTTHLGSRRKFAISIYLSEVSLQKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMVRFNI

SEQ ID NO: 20664 - protein, 119 aa, Homo sapiens
  Payload ID: 4178
  Gene Symbol: CLECL1
  Gene Name: C-type lectin-like 1
  ENSP ID: ENSP00000438981
  MOD_RES (1)..(1): Any amino acid
XYLSEVSLQKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMKSNLF

SEQ ID NO: 20665 - protein, 35 aa, Homo sapiens
  Payload ID: 4178
  Gene Symbol: CLECL1
  Gene Name: C-type lectin-like 1
  ENSP ID: ENSP00000444947
QDITAMLITFLLYLQMAFLQCVYISDVSVYPNFFL

SEQ ID NO: 20666 - protein, 191 aa, Homo sapiens
  Payload ID: 4178
  Gene Symbol: CLECL1
  Gene Name: C-type lectin-like 1
  ENSP ID: ENSP00000483624
MVSNFFHVIQVFEKSATLISKTEHIGFVIYSWRKSTTHLGSRRKFAISIYLSEVSLQKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMLITFLLYLQMAFLQCVYISDVSVYPNFFL

SEQ ID NO: 20667 - protein, 18 aa, Homo sapiens
  Payload ID: 4179
  Gene Symbol:
  Gene Name: CU104787.1
  ENSP ID: ENSP00000485388
AAGSVLLCLLTELLRARL

SEQ ID NO: 20668 - protein, 2967 aa, Homo sapiens
  Payload ID: 4180
  Gene Symbol: CSMD1
  Gene Name: CUB and Sushi multiple domains 1
  ENSP ID: ENSP00000334828
  MOD_RES (1)..(1): Any amino acid
XEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKIPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 20669 - protein, 3388 aa, Homo sapiens
  Payload ID: 4180
  Gene Symbol: CSMD1
  Gene Name: CUB and Sushi multiple domains 1
  ENSP ID: ENSP00000383047
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 20670 - protein, 3565 aa, Homo sapiens
  Payload ID: 4180
  Gene Symbol: CSMD1
  Gene Name: CUB and Sushi multiple domains 1
  ENSP ID: ENSP00000430733
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 20671 - protein, 3426 aa, Homo sapiens
  Payload ID: 4180
  Gene Symbol: CSMD1
  Gene Name: CUB and Sushi multiple domains 1
  ENSP ID: ENSP00000441462
VLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 20672 - protein, 3565 aa, Homo sapiens; identical to SEQ ID NO: 20670
  Payload ID: 4180
  Gene Symbol: CSMD1
  Gene Name: CUB and Sushi multiple domains 1
  ENSP ID: ENSP00000473359

SEQ ID NO: 20673 - protein, 3388 aa, Homo sapiens; identical to SEQ ID NO: 20669
  Payload ID: 4180
  Gene Symbol: CSMD1
  Gene Name: CUB and Sushi multiple domains 1
  ENSP ID: ENSP00000473617

SEQ ID NO: 20674 - protein, 3564 aa, Homo sapiens
  Payload ID: 4180
  Gene Symbol: CSMD1
  Gene Name: CUB and Sushi multiple domains 1
  ENSP ID: ENSP00000489225
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 20675 - protein, 3487 aa, Homo sapiens
  Payload ID: 4181
  Gene Symbol: CSMD2
  Gene Name: CUB and Sushi multiple domains 2
  Uniprot ID: Q7Z408
  ENSP ID: ENSP00000241312
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQDLTYSHQISSFLRGFDLSELERTNSTPPVAASYVWDLDPGCEAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 20676 - protein, 225 aa, Homo sapiens
  Payload ID: 4181
  Gene Symbol: CSMD2
  Gene Name: CUB and Sushi multiple domains 2
  ENSP ID: ENSP00000340311
MCDAHLRGPSGIITSPNFPIQYDNNAHCVWIITALNPSKAGGDPGNIQCNKEGLSVETQSLRLRNRSCLLGNSKDNGCCVPNPVHGTGLQVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVCK

SEQ ID NO: 20677 - protein, 426 aa, Homo sapiens
  Payload ID: 4181
  Gene Symbol: CSMD2
  Gene Name: CUB and Sushi multiple domains 2
  ENSP ID: ENSP00000362475
MLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSDHCRYFNQKSGKLDFTPSSTLGQLCKTLHRSLPHLRLQFLHL

SEQ ID NO: 20678 - protein, 1167 aa, Homo sapiens
  Payload ID: 4181
  Gene Symbol: CSMD2
  Gene Name: CUB and Sushi multiple domains 2
  Uniprot ID: Q7Z408
  ENSP ID: ENSP00000362478
MVIVILFPAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSGHLAAVCTL

SEQ ID NO: 20679 - protein, 3631 aa, Homo sapiens
  Payload ID: 4181
  Gene Symbol: CSMD2
  Gene Name: CUB and Sushi multiple domains 2
  Uniprot ID: Q7Z408
  ENSP ID: ENSP00000362479
MPRSRGRELGRCGCPAGRARGETGISALVPGAGSRWGRPPPPTPPPLLLLLGCGLLSVSAAAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLATQTKLHSIFYKLLFDVLSSPSLTKAGHCGTPEPIVNGHINGENYSYRGSVVYQCNAGFRLIGMSVRICQQDHHWSGKTPFCVPITCGHPGNPVNGLTQGNQFNLNDVVKFVCNPGYMAEGAARSQCLASGQWSDMLPTCRIINCTDPGHQENSVRQVHASGPHRFSFGTTVSYRCNHGFYLLGTPVLSCQGDGTWDRPRPQCLLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 20680 - protein, 3487 aa, Homo sapiens; identical to SEQ ID NO: 20675
  Payload ID: 4181
  Gene Symbol: CSMD2
  Gene Name: CUB and Sushi multiple domains 2
  Uniprot ID: Q7Z408
  ENSP ID: ENSP00000362486

SEQ ID NO: 20681 - protein, 3591 aa, Homo sapiens
  Payload ID: 4181
  Gene Symbol: CSMD2
  Gene Name: CUB and Sushi multiple domains 2
  ENSP ID: ENSP00000483463
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLATQTKLHSIFYKLLFDVLSSPSLTKAGHCGTPEPIVNGHINGENYSYRGSVVYQCNAGFRLIGMSVRICQQDHHWSGKTPFCVPITCGHPGNPVNGLTQGNQFNLNDVVKFVCNPGYMAEGAARSQCLASGQWSDMLPTCRIINCTDPGHQENSVRQVHASGPHRFSFGTTVSYRCNHGFYLLGTPVLSCQGDGTWDRPRPQCLLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 20682 - protein, 3707 aa, Homo sapiens
  Payload ID: 4182
  Gene Symbol: CSMD3
  Gene Name: CUB and Sushi multiple domains 3
  Uniprot ID: Q7Z407
  ENSP ID: ENSP00000297405
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 20683 - protein, 2977 aa, Homo sapiens
  Payload ID: 4182
  Gene Symbol: CSMD3
  Gene Name: CUB and Sushi multiple domains 3
  ENSP ID: ENSP00000341558
KESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 20684 - protein, 3667 aa, Homo sapiens
  Payload ID: 4182
  Gene Symbol: CSMD3
  Gene Name: CUB and Sushi multiple domains 3
  Uniprot ID: Q7Z407
  ENSP ID: ENSP00000345799
MWSWFLCWKPVQLDRQTASGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 20685 - protein, 3538 aa, Homo sapiens
  Payload ID: 4182
  Gene Symbol: CSMD3
  Gene Name: CUB and Sushi multiple domains 3
  Uniprot ID: Q7Z407
  ENSP ID: ENSP00000412263
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 20686 - protein, 47 aa, Homo sapiens
  Payload ID: 4183
  Gene Symbol: CUZD1
  Gene Name: CUB and zona pellucida-like domains 1
  ENSP ID: ENSP00000340905
MELVRRLMPLTLLILSCLAELTMAEAEGRRSVNYLHQYNHLFCILNF

SEQ ID NO: 20687 - protein, 52 aa, Homo sapiens
  Payload ID: 4183
  Gene Symbol: CUZD1
  Gene Name: CUB and zona pellucida-like domains 1
  ENSP ID: ENSP00000357896
MELVRRLMPLTLLILSCLAELTMAEAEGLIQMEAVKVKTLKSLTEPPAMGLC

SEQ ID NO: 20688 - protein, 52 aa, Homo sapiens; identical to SEQ ID NO: 20687
  Payload ID: 4183
  Gene Symbol: CUZD1
  Gene Name: CUB and zona pellucida-like domains 1
  ENSP ID: ENSP00000357897

SEQ ID NO: 20689 - protein, 607 aa, Homo sapiens
  Payload ID: 4183
  Gene Symbol: CUZD1
  Gene Name: CUB and zona pellucida-like domains 1
  Uniprot ID: Q86UP6
  ENSP ID: ENSP00000357900
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 20690 - protein, 607 aa, Homo sapiens; identical to SEQ ID NO: 20689
  Payload ID: 4183
  Gene Symbol: CUZD1
  Gene Name: CUB and zona pellucida-like domains 1
  Uniprot ID: Q86UP6
  ENSP ID: ENSP00000376540

SEQ ID NO: 20691 - protein, 356 aa, Homo sapiens
  Payload ID: 4183
  Gene Symbol: CUZD1
  Gene Name: CUB and zona pellucida-like domains 1
  ENSP ID: ENSP00000441590
MPILTGDFASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 20692 - protein, 836 aa, Homo sapiens
  Payload ID: 4184
  Gene Symbol: CDCP1
  Gene Name: CUB domain containing protein 1
  Uniprot ID: Q9H5V8
  ENSP ID: ENSP00000296129
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 20693 - protein, 343 aa, Homo sapiens
  Payload ID: 4184
  Gene Symbol: CDCP1
  Gene Name: CUB domain containing protein 1
  Uniprot ID: Q9H5V8
  ENSP ID: ENSP00000399342
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 20694 - protein, 449 aa, Homo sapiens
  Payload ID: 4185
  Gene Symbol: CDCP2
  Gene Name: CUB domain containing protein 2
  Uniprot ID: Q5VXM1
  ENSP ID: ENSP00000360381
MLAEWGACLLLAVALLGPGLQAQAMEGVKCGGVLSAPSGNFSSPNFPRLYPYNTECSWLIVVAEGSSVLLTFHAFDLEYHDTCSFDFLEIYNGASPDKGNLLGRFCGKVPPPPFTSSWHVMSVIFHSDKHVASHGFSAGYQKDVCGGVLTGLSGVLTSPEYPNNYPNSMECHWVIRAAGPAHVKLVFVDFQVEGNEECTYDYVAVLGGPGPTRGHHYCGSTRPPTLVSLGHELQVVFKSDFNIGGRGFKAYYFSGECQEVYMAMRGNFSSPQYPSSYPNNIRCHWTIRLPPGYQVKVFFLDLDLEEPNSLTKTCDFDHLAAFDGASEEAPLLGNWCGHHLPPPVTSSHNQLLLLLHTDRSTTRRGFSVAYIGGQLGCGSGSTEGEGEALQPQSLQSPSSIPPVCPAPPMNGLLQLLLHWLHPCPLSGPLRLDGTAPACFHYCRASFPSF

SEQ ID NO: 20695 - protein, 170 aa, Homo sapiens
  Payload ID: 4186
  Gene Symbol: CUBN
  Gene Name: cubilin (intrinsic factor-cobalamin receptor)
  ENSP ID: ENSP00000367054
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKVSHLLFG

SEQ ID NO: 20696 - protein, 3623 aa, Homo sapiens
  Payload ID: 4186
  Gene Symbol: CUBN
  Gene Name: cubilin (intrinsic factor-cobalamin receptor)
  Uniprot ID: O60494
  ENSP ID: ENSP00000367064
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 20697 - protein, 88 aa, Homo sapiens
  Payload ID: 4186
  Gene Symbol: CUBN
  Gene Name: cubilin (intrinsic factor-cobalamin receptor)
  ENSP ID: ENSP00000391830
STGNELAIRFKTDLSINGRGFNASWQAVTGGCGGIFQAPSGEIHSPNYPSPYRSNTDCSWVIRVDRNHRVLLNFTDFDLEPQDSCIMV

SEQ ID NO: 20698 - protein, 105 aa, Homo sapiens
  Payload ID: 4186
  Gene Symbol: CUBN
  Gene Name: cubilin (intrinsic factor-cobalamin receptor)
  ENSP ID: ENSP00000415970
NSKLVDLERKFQGLQQTVDKKVCSSNPCQNGGTCLNLHDSFFCICPPQWKGPLCSADVNECEIYSGTPLSCQNGGTCVNTMGSYRNPCSNIPKEPEEGSRDWHRE

SEQ ID NO: 20699 - protein, 386 aa, Homo sapiens
  Payload ID: 4187
  Gene Symbol: CUEDC1
  Gene Name: CUE domain containing 1
  Uniprot ID: Q9NWM3
  ENSP ID: ENSP00000353373
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 20700 - protein, 386 aa, Homo sapiens; identical to SEQ ID NO: 20699
  Payload ID: 4187
  Gene Symbol: CUEDC1
  Gene Name: CUE domain containing 1
  Uniprot ID: Q9NWM3
  ENSP ID: ENSP00000384712

SEQ ID NO: 20701 - protein, 53 aa, Homo sapiens
  Payload ID: 4187
  Gene Symbol: CUEDC1
  Gene Name: CUE domain containing 1
  ENSP ID: ENSP00000462045
  MOD_RES (1)..(1): Any amino acid
XERDRLKYESQKSKSSSVAVGNDFGFSSPVPDEDFRGRRQEAPKVEEGLREGQ

SEQ ID NO: 20702 - protein, 42 aa, Homo sapiens
  Payload ID: 4187
  Gene Symbol: CUEDC1
  Gene Name: CUE domain containing 1
  ENSP ID: ENSP00000462177
  MOD_RES (1)..(1): Any amino acid
XLGAAASTANLLDDVEGHACDEDFRGRRQEAPKVEEGLREGQ

SEQ ID NO: 20703 - protein, 386 aa, Homo sapiens; identical to SEQ ID NO: 20699
  Payload ID: 4187
  Gene Symbol: CUEDC1
  Gene Name: CUE domain containing 1
  Uniprot ID: Q9NWM3
  ENSP ID: ENSP00000462717

SEQ ID NO: 20704 - protein, 162 aa, Homo sapiens
  Payload ID: 4187
  Gene Symbol: CUEDC1
  Gene Name: CUE domain containing 1
  ENSP ID: ENSP00000462789
MDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCP

SEQ ID NO: 20705 - protein, 249 aa, Homo sapiens
  Payload ID: 4187
  Gene Symbol: CUEDC1
  Gene Name: CUE domain containing 1
  ENSP ID: ENSP00000463666
MHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 20706 - protein, 287 aa, Homo sapiens
  Payload ID: 4188
  Gene Symbol: CUEDC2
  Gene Name: CUE domain containing 2
  Uniprot ID: Q9H467
  ENSP ID: ENSP00000358953
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 20707 - protein, 482 aa, Homo sapiens
  Payload ID: 4189
  Gene Symbol: CELF1
  Gene Name: CUGBP, Elav-like family member 1
  Uniprot ID: Q92879
  ENSP ID: ENSP00000308386
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20708 - protein, 486 aa, Homo sapiens
  Payload ID: 4189
  Gene Symbol: CELF1
  Gene Name: CUGBP, Elav-like family member 1
  Uniprot ID: Q92879
  ENSP ID: ENSP00000351409
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20709 - protein, 483 aa, Homo sapiens
  Payload ID: 4189
  Gene Symbol: CELF1
  Gene Name: CUGBP, Elav-like family member 1
  Uniprot ID: Q92879
  ENSP ID: ENSP00000354639
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALLQQTASSGNLNTLSSLHPMGGLNAMQLQNLAALAAAASAAQNTPSGTNALTTSSSPLSVLTSSAGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20710 - protein, 485 aa, Homo sapiens
  Payload ID: 4189
  Gene Symbol: CELF1
  Gene Name: CUGBP, Elav-like family member 1
  Uniprot ID: Q92879
  ENSP ID: ENSP00000378705
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20711 - protein, 483 aa, Homo sapiens; identical to SEQ ID NO: 20709
  Payload ID: 4189
  Gene Symbol: CELF1
  Gene Name: CUGBP, Elav-like family member 1
  Uniprot ID: Q92879
  ENSP ID: ENSP00000378706

SEQ ID NO: 20712 - protein, 95 aa, Homo sapiens
  Payload ID: 4189
  Gene Symbol: CELF1
  Gene Name: CUGBP, Elav-like family member 1
  ENSP ID: ENSP00000433986
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMK

SEQ ID NO: 20713 - protein, 114 aa, Homo sapiens
  Payload ID: 4189
  Gene Symbol: CELF1
  Gene Name: CUGBP, Elav-like family member 1
  ENSP ID: ENSP00000435320
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQNALHNMKVLPG

SEQ ID NO: 20714 - protein, 56 aa, Homo sapiens
  Payload ID: 4189
  Gene Symbol: CELF1
  Gene Name: CUGBP, Elav-like family member 1
  ENSP ID: ENSP00000435423
MNGTLDHPDQPDLDAIKMFVGQVPRTWSEKDLRELFEQYGAVYEINVLRDRSQNPP

SEQ ID NO: 20715 - protein, 512 aa, Homo sapiens
  Payload ID: 4189
  Gene Symbol: CELF1
  Gene Name: CUGBP, Elav-like family member 1
  Uniprot ID: Q92879
  ENSP ID: ENSP00000435926
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20716 - protein, 87 aa, Homo sapiens
  Payload ID: 4189
  Gene Symbol: CELF1
  Gene Name: CUGBP, Elav-like family member 1
  ENSP ID: ENSP00000436191
MNGTLDHPDQPDLDAIKMFVGQVPRTWSEKDLRELFEQYGAVYEINVLRDRSQNPPQSKGCCFVTFYTRKAALEAQNALHNMKVLPG

SEQ ID NO: 20717 - protein, 514 aa, Homo sapiens
  Payload ID: 4189
  Gene Symbol: CELF1
  Gene Name: CUGBP, Elav-like family member 1
  ENSP ID: ENSP00000436864
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSAGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 20718 - protein, 103 aa, Homo sapiens
  Payload ID: 4189
  Gene Symbol: CELF1
  Gene Name: CUGBP, Elav-like family member 1
  ENSP ID: ENSP00000438044
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQ

SEQ ID NO: 20719 - protein, 37 aa, Homo sapiens
  Payload ID: 4189
  Gene Symbol: CELF1
  Gene Name: CUGBP, Elav-like family member 1
  ENSP ID: ENSP00000438862
MAAFKLDFLPEMMVDHCSLNSSPVSKKMNGTLDHPDQ

SEQ ID NO: 20720 - protein, 14 aa, Homo sapiens
  Payload ID: 4189
  Gene Symbol: CELF1
  Gene Name: CUGBP, Elav-like family member 1
  ENSP ID: ENSP00000442415
MNGTLDHPDQPDLD

SEQ ID NO: 20721 - protein, 78 aa, Homo sapiens
  Payload ID: 4189
  Gene Symbol: CELF1
  Gene Name: CUGBP, Elav-like family member 1
  ENSP ID: ENSP00000444825
MNGTLDHPDQPDLDAIKMFVGQVPRTWSEKDLRELFEQYGAVYEINVLRDRSQNPPQSKGCCFVTFYTRKAALEAQNA

SEQ ID NO: 20722 - protein, 502 aa, Homo sapiens
  Payload ID: 4190
  Gene Symbol: CELF2
  Gene Name: CUGBP, Elav-like family member 2
  ENSP ID: ENSP00000346971
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINTPRSKRLLLPKDNNGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20723 - protein, 490 aa, Homo sapiens
  Payload ID: 4190
  Gene Symbol: CELF2
  Gene Name: CUGBP, Elav-like family member 2
  Uniprot ID: O95319
  ENSP ID: ENSP00000382743
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20724 - protein, 490 aa, Homo sapiens; identical to SEQ ID NO: 20723
  Payload ID: 4190
  Gene Symbol: CELF2
  Gene Name: CUGBP, Elav-like family member 2
  Uniprot ID: O95319
  ENSP ID: ENSP00000404834

SEQ ID NO: 20725 - protein, 508 aa, Homo sapiens
  Payload ID: 4190
  Gene Symbol: CELF2
  Gene Name: CUGBP, Elav-like family member 2
  Uniprot ID: O95319
  ENSP ID: ENSP00000406451
MRCPKSAVTMRNEELLLSNGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20726 - protein, 521 aa, Homo sapiens
  Payload ID: 4190
  Gene Symbol: CELF2
  Gene Name: CUGBP, Elav-like family member 2
  ENSP ID: ENSP00000443926
MTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20727 - protein, 70 aa, Homo sapiens
  Payload ID: 4190
  Gene Symbol: CELF2
  Gene Name: CUGBP, Elav-like family member 2
  ENSP ID: ENSP00000476392
MNGALDHSDQPDPDAIKMFVGQIPRSWSEKELKELFEPYGAVYQINVLRDRSQNPPQSKDASSHSDETCR

SEQ ID NO: 20728 - protein, 440 aa, Homo sapiens
  Payload ID: 4190
  Gene Symbol: CELF2
  Gene Name: CUGBP, Elav-like family member 2
  ENSP ID: ENSP00000476656
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINSMAALNGGLGATGLTNGTAGTMDALTQAYSGIQQYAAAALPTLYSQSLLQQQSAAGSQKEGFVSYDNPVSAQAAIQAMNGFQIGMKRLKVQLKRSKNDSKPY

SEQ ID NO: 20729 - protein, 488 aa, Homo sapiens
  Payload ID: 4190
  Gene Symbol: CELF2
  Gene Name: CUGBP, Elav-like family member 2
  Uniprot ID: O95319
  ENSP ID: ENSP00000476999
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINSMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20730 - protein, 490 aa, Homo sapiens; identical to SEQ ID NO: 20723
  Payload ID: 4190
  Gene Symbol: CELF2
  Gene Name: CUGBP, Elav-like family member 2
  Uniprot ID: O95319
  ENSP ID: ENSP00000487802

SEQ ID NO: 20731 - protein, 514 aa, Homo sapiens
  Payload ID: 4190
  Gene Symbol: CELF2
  Gene Name: CUGBP, Elav-like family member 2
  ENSP ID: ENSP00000488268
MRCPKSAVTMRNEELLLSNGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20732 - protein, 533 aa, Homo sapiens
  Payload ID: 4190
  Gene Symbol: CELF2
  Gene Name: CUGBP, Elav-like family member 2
  ENSP ID: ENSP00000488422
MTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINTPRSKRLLLPKDNNGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 20733 - protein, 94 aa, Homo sapiens
  Payload ID: 4190
  Gene Symbol: CELF2
  Gene Name: CUGBP, Elav-like family member 2
  ENSP ID: ENSP00000488438
MRCPKSAVTMRNEELLLSNGTANKMNGALDHSDQPDPDAIKMFVGQIPRSWSEKELKELFEPYGAVYQINVLRDRSQNPPQSKDASSHSDETCR

SEQ ID NO: 20734 - protein, 508 aa, Homo sapiens; identical to SEQ ID NO: 20725
  Payload ID: 4190
  Gene Symbol: CELF2
  Gene Name: CUGBP, Elav-like family member 2
  Uniprot ID: O95319
  ENSP ID: ENSP00000488582

SEQ ID NO: 20735 - protein, 521 aa, Homo sapiens; identical to SEQ ID NO: 20726
  Payload ID: 4190
  Gene Symbol: CELF2
  Gene Name: CUGBP, Elav-like family member 2
  ENSP ID: ENSP00000488690

SEQ ID NO: 20736 - protein, 465 aa, Homo sapiens
  Payload ID: 4191
  Gene Symbol: CELF3
  Gene Name: CUGBP, Elav-like family member 3
  Uniprot ID: Q5SZQ8
  ENSP ID: ENSP00000290583
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 20737 - protein, 415 aa, Homo sapiens
  Payload ID: 4191
  Gene Symbol: CELF3
  Gene Name: CUGBP, Elav-like family member 3
  Uniprot ID: Q5SZQ8
  ENSP ID: ENSP00000290585
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 20738 - protein, 466 aa, Homo sapiens
  Payload ID: 4191
  Gene Symbol: CELF3
  Gene Name: CUGBP, Elav-like family member 3
  ENSP ID: ENSP00000402503
  MOD_RES (1)..(1): Any amino acid
XVEESAAGEQSSGTQIPRHLEEKDLKPIFEQFGRIFELTVIKDKYTGLHKGCAFLTYCARDSALKAQSALHEQKTLPGMNRPIQVKPADSESRGDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 20739 - protein, 448 aa, Homo sapiens
  Payload ID: 4192
  Gene Symbol: CELF4
  Gene Name: CUGBP, Elav-like family member 4
  Uniprot ID: Q9BZC1
  ENSP ID: ENSP00000335631
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGEDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGFVSFDNPASAQTAIQAMNGFQIGMKRLKVQLKRPKDANRPY

SEQ ID NO: 20740 - protein, 484 aa, Homo sapiens
  Payload ID: 4192
  Gene Symbol: CELF4
  Gene Name: CUGBP, Elav-like family member 4
  Uniprot ID: Q9BZC1
  ENSP ID: ENSP00000355089
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSHRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQAMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 20741 - protein, 486 aa, Homo sapiens
  Payload ID: 4192
  Gene Symbol: CELF4
  Gene Name: CUGBP, Elav-like family member 4
  Uniprot ID: Q9BZC1
  ENSP ID: ENSP00000410584
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 20742 - protein, 486 aa, Homo sapiens; identical to SEQ ID NO: 20741
  Payload ID: 4192
  Gene Symbol: CELF4
  Gene Name: CUGBP, Elav-like family member 4
  Uniprot ID: Q9BZC1
  ENSP ID: ENSP00000464794

SEQ ID NO: 20743 - protein, 484 aa, Homo sapiens
  Payload ID: 4192
  Gene Symbol: CELF4
  Gene Name: CUGBP, Elav-like family member 4
  Uniprot ID: Q9BZC1
  ENSP ID: ENSP00000464917
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSHRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAAAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 20744 - protein, 138 aa, Homo sapiens
  Payload ID: 4192
  Gene Symbol: CELF4
  Gene Name: CUGBP, Elav-like family member 4
  ENSP ID: ENSP00000464996
MTPTSGGSTPPGITAPAVPSIPSPIGVNGFTGLPPQANGQPAAEAVFANGIHPYPAQSPTAADPLQQAYAGVQQYAGPAYPAAYGQISQAFPQPPPMIPQQQREGFVSFDNPASAQTAIQAMNGFQIGMKRLKVQLKR

SEQ ID NO: 20745 - protein, 181 aa, Homo sapiens
  Payload ID: 4192
  Gene Symbol: CELF4
  Gene Name: CUGBP, Elav-like family member 4
  ENSP ID: ENSP00000465125
MTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGNVISSKVFVDRATNQSKCFGFVSFDNPASAQTAIQAMNGFQIGMKRL

SEQ ID NO: 20746 - protein, 162 aa, Homo sapiens
  Payload ID: 4192
  Gene Symbol: CELF4
  Gene Name: CUGBP, Elav-like family member 4
  ENSP ID: ENSP00000465211
MNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYL

SEQ ID NO: 20747 - protein, 115 aa, Homo sapiens
  Payload ID: 4192
  Gene Symbol: CELF4
  Gene Name: CUGBP, Elav-like family member 4
  ENSP ID: ENSP00000465348
  MOD_RES (1)..(1): Any amino acid
XGGSTPPGITAPAVPSIPSPIGVNGFTGLPPQANGQPAAEAVFANGIHPYPAQSPTAADPLQQAYAGVQQYAGRFVSFDNPASAQTAIQAMNGFQIGMKRLKVQLKRPKDANRPY

SEQ ID NO: 20748 - protein, 132 aa, Homo sapiens
  Payload ID: 4192
  Gene Symbol: CELF4
  Gene Name: CUGBP, Elav-like family member 4
  ENSP ID: ENSP00000467056
MTPTSGGSTPPGITAPAVPSIPSPIGVNGFTGLPPQANGQPAAEAVFANGIHPYPAQSPTAADPLQQAYAGVQQYAAAAYPAAYGQISQAFPQPPPMIPQQQREGPEGCNLFIYHLPQEFGDAELMQMFLPF

SEQ ID NO: 20749 - protein, 67 aa, Homo sapiens
  Payload ID: 4192
  Gene Symbol: CELF4
  Gene Name: CUGBP, Elav-like family member 4
  ENSP ID: ENSP00000467571
MNRPIQVKPADSESRGGKDRKLFVGMLNKQQSEDDVRRLFEAFGNIEECTILRGPDGNSKGCAFVKY

SEQ ID NO: 20750 - protein, 154 aa, Homo sapiens
  Payload ID: 4192
  Gene Symbol: CELF4
  Gene Name: CUGBP, Elav-like family member 4
  ENSP ID: ENSP00000467732
MNRPIQVKPADSESRGDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPM

SEQ ID NO: 20751 - protein, 454 aa, Homo sapiens
  Payload ID: 4192
  Gene Symbol: CELF4
  Gene Name: CUGBP, Elav-like family member 4
  ENSP ID: ENSP00000468109
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAYPAAYGQISQAFPQPPPMIPQQQREGPEGCNLFIYHLPQEFGDAELMQMFLPFGNVISSKVFVDRATNQSKCFGG

SEQ ID NO: 20752 - protein, 151 aa, Homo sapiens
  Payload ID: 4192
  Gene Symbol: CELF4
  Gene Name: CUGBP, Elav-like family member 4
  ENSP ID: ENSP00000468256
AAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGFVSFDNPASAQTAIQAMNGFQIGMKRLKVQLKRPKDANRPY

SEQ ID NO: 20753 - protein, 250 aa, Homo sapiens
  Payload ID: 4192
  Gene Symbol: CELF4
  Gene Name: CUGBP, Elav-like family member 4
  ENSP ID: ENSP00000468428
MNRPIQVKPADSESRGDRKLFVGMLNKQQSEDDVRRLFEAFGNIEECTILRGPDGNSKGCAFVKYSSHAEAQAAINALHGSQTMPVSAGPLGRGRGQRRAETPAPATPRRLSSLPKRQESMTLIPGLRQGRGSPGMLRNWPEVTQVENARGGVHTSFPWASADAASSKAPRGAGGVGAGQRHRQLRAEALEQVGLTRRPGRREPRPVWWSSSPTPTRSARCGECSRWLARWACSTPWPSLSGPTAPTLRQ

SEQ ID NO: 20754 - protein, 484 aa, Homo sapiens
  Payload ID: 4192
  Gene Symbol: CELF4
  Gene Name: CUGBP, Elav-like family member 4
  ENSP ID: ENSP00000469627
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSHRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQLMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 20755 - protein, 294 aa, Homo sapiens
  Payload ID: 4192
  Gene Symbol: CELF4
  Gene Name: CUGBP, Elav-like family member 4
  ENSP ID: ENSP00000470649
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGEDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQALMQQQAALMASVAQGGYLNPMAAFAAAQMQQMAALNM

SEQ ID NO: 20756 - protein, 69 aa, Homo sapiens
  Payload ID: 4192
  Gene Symbol: CELF4
  Gene Name: CUGBP, Elav-like family member 4
  ENSP ID: ENSP00000471616
  MOD_RES (1)..(1): Any amino acid
XAYPAAYGQISQAFPQPPPMIPQQQREGFVSFDNPASAQTAIQAMNGFQIGMKRLKVQLKRPKDANRPY

SEQ ID NO: 20757 - protein, 485 aa, Homo sapiens
  Payload ID: 4192
  Gene Symbol: CELF4
  Gene Name: CUGBP, Elav-like family member 4
  ENSP ID: ENSP00000474788
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQKTLPGMNRPIQVKPADSESRGGSSCLRQPPSQDRKLFVGMLNKQQSEDDVRRLFEAFGNIEECTILRGPDGNSKGCAFVKYSSHAEAQAAINALHGSQTMPGASSSLVVKFADTDKERTMRRMQQMAGQMGMFNPMAIPFGAYGAYAQAMQQQAALMASVAQGGYLNPMAAFAAAQMQQMAALNMNGLAAAPMTPTSGGSTPPGITAPAVPSIPSPIGVNGFTGLPPQANGQPAAEAVFANGIHPYPAQSPTAADPLQQAYAGVQQYAGPAAYPAAYGQISQAFPQPPPMIPQQQREGPEGCNLFIYHLPQEFGDAELMQMFLPFGFVSFDNPASAQTAIQAMNGFQIGMKRLKVQLKRPKDANRPY

SEQ ID NO: 20758 - protein, 485 aa, Homo sapiens
  Payload ID: 4193
  Gene Symbol: CELF5
  Gene Name: CUGBP, Elav-like family member 5
  Uniprot ID: Q8N6W0
  ENSP ID: ENSP00000292672
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGPEGCNLFIYHLPQEFGDTELTQMFLPFGNIISSKVFMDRATNQSKCFGFVSFDNPASAQAAIQAMNGFQIGMKRLKVQLKRPKDPGHPY

SEQ ID NO: 20759 - protein, 320 aa, Homo sapiens
  Payload ID: 4193
  Gene Symbol: CELF5
  Gene Name: CUGBP, Elav-like family member 5
  ENSP ID: ENSP00000335182
MARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGVWRHGADADVPTLRQYHFLQGVYGSSYQPEQVFRLREL

SEQ ID NO: 20760 - protein, 409 aa, Homo sapiens
  Payload ID: 4193
  Gene Symbol: CELF5
  Gene Name: CUGBP, Elav-like family member 5
  Uniprot ID: Q8N6W0
  ENSP ID: ENSP00000443498
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGVVPFPGGHPALETVYANGLVPYPAQSPTVAETLHPAFSGVQQYTAMYPTAAITPIAHSVPQPPPLLQQQQREGVWRHGADADVPTLRQYHFLQGVYGSSYQPEQVFRLREL

SEQ ID NO: 20761 - protein, 295 aa, Homo sapiens
  Payload ID: 4193
  Gene Symbol: CELF5
  Gene Name: CUGBP, Elav-like family member 5
  ENSP ID: ENSP00000468503
MLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGVWRHGADADVPTLRQYHFLQGVYGSSYQPEQVFRLREL

SEQ ID NO: 20762 - protein, 481 aa, Homo sapiens
  Payload ID: 4194
  Gene Symbol: CELF6
  Gene Name: CUGBP, Elav-like family member 6
  Uniprot ID: Q96J87
  ENSP ID: ENSP00000287202
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 20763 - protein, 368 aa, Homo sapiens
  Payload ID: 4194
  Gene Symbol: CELF6
  Gene Name: CUGBP, Elav-like family member 6
  Uniprot ID: Q96J87
  ENSP ID: ENSP00000378677
MISDPPSNNSWNSVLYLLEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 20764 - protein, 133 aa, Homo sapiens
  Payload ID: 4194
  Gene Symbol: CELF6
  Gene Name: CUGBP, Elav-like family member 6
  ENSP ID: ENSP00000400439
SGLNPGPAVPMKDHDAIKLFVGQIPRGLDEQDLKPLFEEFGRIYELTVLKDRLTGLHKGCAFLTYCARDSALKAQSALHEQKTLPGRTESCLWGCWASSRVRRTSDACSSPLATSRSARSCGVLTAPVKAVPL

SEQ ID NO: 20765 - protein, 344 aa, Homo sapiens
  Payload ID: 4194
  Gene Symbol: CELF6
  Gene Name: CUGBP, Elav-like family member 6
  Uniprot ID: Q96J87
  ENSP ID: ENSP00000439956
MNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAANSPPGSGPGTLPGLPAPIGVNGFGPLTPQTNGQPGSDTLYNNGLSPYPAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 20766 - protein, 454 aa, Homo sapiens
  Payload ID: 4194
  Gene Symbol: CELF6
  Gene Name: CUGBP, Elav-like family member 6
  Uniprot ID: Q96J87
  ENSP ID: ENSP00000457863
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 20767 - protein, 776 aa, Homo sapiens
  Payload ID: 4195
  Gene Symbol: CUL1
  Gene Name: cullin 1
  Uniprot ID: Q13616
  ENSP ID: ENSP00000326804
MSSTRSQNPHGLKQIGLDQIWDDLRAGIQQVYTRQSMAKSRYMELYTHVYNYCTSVHQSNQARGAGVPPSKSKKGQTPGGAQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 20768 - protein, 776 aa, Homo sapiens; identical to SEQ ID NO: 20767
  Payload ID: 4195
  Gene Symbol: CUL1
  Gene Name: cullin 1
  Uniprot ID: Q13616
  ENSP ID: ENSP00000387160

SEQ ID NO: 20769 - protein, 776 aa, Homo sapiens; identical to SEQ ID NO: 20767
  Payload ID: 4195
  Gene Symbol: CUL1
  Gene Name: cullin 1
  Uniprot ID: Q13616
  ENSP ID: ENSP00000473318

SEQ ID NO: 20770 - protein, 752 aa, Homo sapiens
  Payload ID: 4195
  Gene Symbol: CUL1
  Gene Name: cullin 1
  ENSP ID: ENSP00000482123
MSSTRSQNPHGLKQIGLDQIWDDLRAGIQQVYTRQSMAKSRYMELYTHVYNYCTSVHQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 20771 - protein, 706 aa, Homo sapiens
  Payload ID: 4196
  Gene Symbol: CUL2
  Gene Name: cullin 2
  ENSP ID: ENSP00000363878
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQVISQSRARFNPSISMIKKCIEVLIDKQYIERSQASADEYSYVA

SEQ ID NO: 20772 - protein, 745 aa, Homo sapiens
  Payload ID: 4196
  Gene Symbol: CUL2
  Gene Name: cullin 2
  Uniprot ID: Q13617
  ENSP ID: ENSP00000363880
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 20773 - protein, 745 aa, Homo sapiens; identical to SEQ ID NO: 20772
  Payload ID: 4196
  Gene Symbol: CUL2
  Gene Name: cullin 2
  Uniprot ID: Q13617
  ENSP ID: ENSP00000363881

SEQ ID NO: 20774 - protein, 745 aa, Homo sapiens; identical to SEQ ID NO: 20772
  Payload ID: 4196
  Gene Symbol: CUL2
  Gene Name: cullin 2
  Uniprot ID: Q13617
  ENSP ID: ENSP00000363883

SEQ ID NO: 20775 - protein, 90 aa, Homo sapiens
  Payload ID: 4196
  Gene Symbol: CUL2
  Gene Name: cullin 2
  ENSP ID: ENSP00000363886
MSLKPRVVDFDETWNKLLTTIKAVVMLEYVERATWNDRFSDIYALCVAYPEPLGERLYTETKIFLENHVRHLHKVLGRIQQGCRLYGLLI

SEQ ID NO: 20776 - protein, 764 aa, Homo sapiens
  Payload ID: 4196
  Gene Symbol: CUL2
  Gene Name: cullin 2
  Uniprot ID: Q13617
  ENSP ID: ENSP00000414095
MYRVTWSTFWLRFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 20777 - protein, 758 aa, Homo sapiens
  Payload ID: 4196
  Gene Symbol: CUL2
  Gene Name: cullin 2
  ENSP ID: ENSP00000444856
MVPGKEFQHYTCTMSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 20778 - protein, 706 aa, Homo sapiens; identical to SEQ ID NO: 20771
  Payload ID: 4196
  Gene Symbol: CUL2
  Gene Name: cullin 2
  ENSP ID: ENSP00000485986

SEQ ID NO: 20779 - protein, 768 aa, Homo sapiens
  Payload ID: 4197
  Gene Symbol: CUL3
  Gene Name: cullin 3
  Uniprot ID: Q13618
  ENSP ID: ENSP00000264414
MSNLSKGTGSRKDTKMRIRAFPMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 20780 - protein, 702 aa, Homo sapiens
  Payload ID: 4197
  Gene Symbol: CUL3
  Gene Name: cullin 3
  Uniprot ID: Q13618
  ENSP ID: ENSP00000343601
MSNLSKGTGSRKDTKMRIRAFPVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 20781 - protein, 744 aa, Homo sapiens
  Payload ID: 4197
  Gene Symbol: CUL3
  Gene Name: cullin 3
  Uniprot ID: Q13618
  ENSP ID: ENSP00000386525
MDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIARERKGEVVDRGAIRNACQMLMILGLEGRSVYEEDFEAPFLEMSAEFFQMESQKFLAENSASVYIKKVEARINEEIERVMHCLDKSTEEPIVKVVERELISKHMKTIVEMENSGLVHMLKNGKTEDLGCMYKLFSRVPNGLKTMCECMSSYLREQGKALVSEEGEGKNPVDYIQGLLDLKSRFDRFLLESFNNDRLFKQTIAGDFEYFLNLNSRSPEYLSLFIDDKLKKGVKGLTEQEVETILDKAMVLFRFMQEKDVFERYYKQHLARRLLTNKSVSDDSEKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 20782 - protein, 744 aa, Homo sapiens; identical to SEQ ID NO: 20781
  Payload ID: 4197
  Gene Symbol: CUL3
  Gene Name: cullin 3
  Uniprot ID: Q13618
  ENSP ID: ENSP00000387200

SEQ ID NO: 20783 - protein, 43 aa, Homo sapiens
  Payload ID: 4197
  Gene Symbol: CUL3
  Gene Name: cullin 3
  ENSP ID: ENSP00000400558
HILQVSTFQMTILMLFNNREKYTFELLPNKVNPTQRGKKQGRK

SEQ ID NO: 20784 - protein, 192 aa, Homo sapiens
  Payload ID: 4197
  Gene Symbol: CUL3
  Gene Name: cullin 3
  ENSP ID: ENSP00000400935
  MOD_RES (1)..(1): Any amino acid
XVESDKSQGQSSQGENDLNGSGKVVYKRCRGIMFSKRKLRYTEMTMDEKYVNSIWDLLKNAIQEIQRKNNSGLSFEELYRNAYTMVLHKHGEKLYTGLREVVTEHLINKVREDVLNSLNNNFLQTLNQAWNDHQTAMVMIRDILMYMDRVYVQQNNVENVYNLGLIIFRDQVVRYGCIRDHLRQTLLDMIAR

SEQ ID NO: 20785 - protein, 111 aa, Homo sapiens
  Payload ID: 4197
  Gene Symbol: CUL3
  Gene Name: cullin 3
  ENSP ID: ENSP00000410575
  MOD_RES (1)..(1): Any amino acid
XLTLQHHMGSADLNATFYGPVKKEDGSEVGVGGAQVTGSNTRKHILQVSTFQMTILMLFNNREKYTFEVTQQLKARFLPSPVVIKKRIEGLIEREYLARTPEDRKVYTYVA

SEQ ID NO: 20786 - protein, 342 aa, Homo sapiens
  Payload ID: 4197
  Gene Symbol: CUL3
  Gene Name: cullin 3
  ENSP ID: ENSP00000477851
MYLNVIINNTWQGDFSQIKVFLMTLKNMISKLKTECGCQFTSKLEGMFRDMSISNTTMDEFRQHLQATGVSLGGVDLTVRVLTTGYWPTQSATPKCNIPPAPRHAFEIFRRFYLAKHSGRQLTLQHHMGSADLNATFYGPVKKEDGSEVGVGGAQVTGSNTRKHILQVSTFQMTILMLFNNREKYTFEEIQQETDIPERELVRALQSLACGKPTQRVLTKEPKSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 20787 - protein, 55 aa, Homo sapiens
  Payload ID: 4197
  Gene Symbol: CUL3
  Gene Name: cullin 3
  ENSP ID: ENSP00000484410
DLLKNAIQEIQRKNNSGLSFEELYRNAYTMVLHKHGEKLYTGLREVVTEHLINKE

SEQ ID NO: 20788 - protein, 667 aa, Homo sapiens
  Payload ID: 4198
  Gene Symbol: CUL4A
  Gene Name: cullin 4A
  ENSP ID: ENSP00000322132
MLYKQLRQACEDHVQAQILPFREDSLDSVLFLKKINTCWQDHCRQMIMIRSIFLFLDRTYVLQNSTLPSICPVSYCLYRDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 20789 - protein, 759 aa, Homo sapiens
  Payload ID: 4198
  Gene Symbol: CUL4A
  Gene Name: cullin 4A
  Uniprot ID: Q13619
  ENSP ID: ENSP00000364589
MADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 20790 - protein, 659 aa, Homo sapiens
  Payload ID: 4198
  Gene Symbol: CUL4A
  Gene Name: cullin 4A
  Uniprot ID: Q13619
  ENSP ID: ENSP00000364590
MLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 20791 - protein, 659 aa, Homo sapiens; identical to SEQ ID NO: 20790
  Payload ID: 4198
  Gene Symbol: CUL4A
  Gene Name: cullin 4A
  Uniprot ID: Q13619
  ENSP ID: ENSP00000389118

SEQ ID NO: 20792 - protein, 174 aa, Homo sapiens
  Payload ID: 4198
  Gene Symbol: CUL4A
  Gene Name: cullin 4A
  ENSP ID: ENSP00000480367
MADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSICQNH

SEQ ID NO: 20793 - protein, 659 aa, Homo sapiens; identical to SEQ ID NO: 20790
  Payload ID: 4198
  Gene Symbol: CUL4A
  Gene Name: cullin 4A
  Uniprot ID: Q13619
  ENSP ID: ENSP00000481782

SEQ ID NO: 20794 - protein, 900 aa, Homo sapiens
  Payload ID: 4199
  Gene Symbol: CUL4B
  Gene Name: cullin 4B
  ENSP ID: ENSP00000338919
MKSVCPVTSGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 20795 - protein, 895 aa, Homo sapiens
  Payload ID: 4199
  Gene Symbol: CUL4B
  Gene Name: cullin 4B
  Uniprot ID: Q13620
  ENSP ID: ENSP00000360373
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 20796 - protein, 234 aa, Homo sapiens
  Payload ID: 4199
  Gene Symbol: CUL4B
  Gene Name: cullin 4B
  ENSP ID: ENSP00000360374
MIDPDFADKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLIT

SEQ ID NO: 20797 - protein, 913 aa, Homo sapiens
  Payload ID: 4199
  Gene Symbol: CUL4B
  Gene Name: cullin 4B
  Uniprot ID: Q13620
  ENSP ID: ENSP00000384109
MMSQSSGSGDGNDDEATTSKDGGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 20798 - protein, 780 aa, Homo sapiens
  Payload ID: 4200
  Gene Symbol: CUL5
  Gene Name: cullin 5
  Uniprot ID: Q93034
  ENSP ID: ENSP00000376808
MATSNLLKNKGSLQFEDKWDFMRPIVLKLLRQESVTKQQWFDLFSDVHAVCLWDDKGPAKIHQALKEDILEFIKQAQARVLSHQDDTALLKAYIVEWRKFFTQCDILPKPFCQLEITLMGKQGSNKKSNVEDSIVRKLMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKAYKAVVNDATIFKLELPLKQKGVGLKTQPESKCPELLANYCDMLLRKTPLSKKLTSEEIEAKLKEVLLVLKYVQNKDVFMRYHKAHLTRRLILDISADSEIEENMVEWLREVGMPADYVNKLARMFQDIKVSEDLNQAFKEMHKNNKLALPADSVNIKILNAGAWSRSSEKVFVSLPTELEDLIPEVEEFYKKNHSGRKLHWHHLMSNGIITFKNEVGQYDLEVTTFQLAVLFAWNQRPREKISFENLKLATELPDAELRRTLWSLVAFPKLKRQVLLYEPQVNSPKDFTEGTLFSVNQEFSLIKNAKVQKRGKINLIGRLQLTTERMREEENEGIVQLRILRTQEAIIQIMKMRKKISNAQLQTELVEILKNMFLPQKKMIKEQIEWLIEHKYIRRDESDINTFIYMA

SEQ ID NO: 20799 - protein, 130 aa, Homo sapiens
  Payload ID: 4200
  Gene Symbol: CUL5
  Gene Name: cullin 5
  ENSP ID: ENSP00000431221
  MOD_RES (1)..(1): Any amino acid
XDVHAVCLWDDKGPAKIHQALKEDILEFIKQAQALMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKY

SEQ ID NO: 20800 - protein, 780 aa, Homo sapiens; identical to SEQ ID NO: 20798
  Payload ID: 4200
  Gene Symbol: CUL5
  Gene Name: cullin 5
  Uniprot ID: Q93034
  ENSP ID: ENSP00000435376

SEQ ID NO: 20801 - protein, 47 aa, Homo sapiens
  Payload ID: 4200
  Gene Symbol: CUL5
  Gene Name: cullin 5
  ENSP ID: ENSP00000436494
MATSNLLKNKGSLQFEDKWDFMRPIVLKLLRQESVTKQQWFDLFSEY

SEQ ID NO: 20802 - protein, 1698 aa, Homo sapiens
  Payload ID: 4201
  Gene Symbol: CUL7
  Gene Name: cullin 7
  Uniprot ID: Q14999
  ENSP ID: ENSP00000265348
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 20803 - protein, 1782 aa, Homo sapiens
  Payload ID: 4201
  Gene Symbol: CUL7
  Gene Name: cullin 7
  Uniprot ID: Q14999
  ENSP ID: ENSP00000438788
MSRGFWLAEPLAGTGPHPAPVAADSRGCSSVPRRHAPSRLSVSTPSRGPGARMVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGEGQCGEEGKAGEGLGRLRDSQDTVAGASDLIRTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 20804 - protein, 2517 aa, Homo sapiens
  Payload ID: 4202
  Gene Symbol: CUL9
  Gene Name: cullin 9
  Uniprot ID: Q8IWT3
  ENSP ID: ENSP00000252050
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDSRYTLLELFAETTSSEEHCMAFEGIHLPQIPGKLLFSLVKRYLCVTSLLDQLNSSPELGAGDQSSPCATREKSRGQRELEFSMAVGNLISELVRSMGWARNLSEQGMSPPRPTRSIFQPYISGPSLLLPTIVTTPRRQGWVFRQRSEFSSRSGYGEYVQQTLQPGMRVRMLDDYEEISAGDEGEFRQSNNGIPPVQVFWQSTGRTYWVHWHMLEILGPEEATEDKASAAVEKGAGATVLGTAFPSWDWNPMDGLYPLPYLQPEPQKNERVGYLTQAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 20805 - protein, 2489 aa, Homo sapiens
  Payload ID: 4202
  Gene Symbol: CUL9
  Gene Name: cullin 9
  ENSP ID: ENSP00000361730
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDSRYTLLELFAETTSSEEHCMAFEGIHLPQIPGKLLFSLVKRYLCVTSLLDQLNSSPELGAGDQSSPCATREKSRGQRELEFSMAVGNLISELVRSMGWARNLSEQGMSPPRPTRSIFQPYISGPSLLLPTIVTTPRRQGWVFRQRSEFSSRSGYGEYVQQTLQPGMRVRMLDDYEEISAGDEGEFRQSNNGIPPVQVFWQSTGRTYWVHWHMLEILGPEEATEDKASAAVEKGAGATVLGTAFPSWDWNPMDGLYPLPYLQPEPQKNERVGYLTQAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 20806 - protein, 93 aa, Homo sapiens
  Payload ID: 4202
  Gene Symbol: CUL9
  Gene Name: cullin 9
  ENSP ID: ENSP00000421116
CFPNRLPQLMLQSLSTSEELQRQFHLFQLQRLDKLFLEQEDEEEKRLEEEEVRTIQSWTWDHIGDCSGRGWAGLSCSLGSRYCMCPPCRCGCC

SEQ ID NO: 20807 - protein, 195 aa, Homo sapiens
  Payload ID: 4202
  Gene Symbol: CUL9
  Gene Name: cullin 9
  ENSP ID: ENSP00000425649
QKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLLAGMST

SEQ ID NO: 20808 - protein, 54 aa, Homo sapiens
  Payload ID: 4203
  Gene Symbol: CAND1
  Gene Name: cullin-associated and neddylation-dissociated 1
  ENSP ID: ENSP00000437594
MATNDLMTELQKDSIKLDDDSERKVVKMILKLLEDKNGEVQNLAVKCLGPLVSK

SEQ ID NO: 20809 - protein, 1230 aa, Homo sapiens
  Payload ID: 4203
  Gene Symbol: CAND1
  Gene Name: cullin-associated and neddylation-dissociated 1
  Uniprot ID: Q86VP6
  ENSP ID: ENSP00000442318
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 20810 - protein, 770 aa, Homo sapiens
  Payload ID: 4203
  Gene Symbol: CAND1
  Gene Name: cullin-associated and neddylation-dissociated 1
  ENSP ID: ENSP00000444089
HVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 20811 - protein, 442 aa, Homo sapiens
  Payload ID: 4203
  Gene Symbol: CAND1
  Gene Name: cullin-associated and neddylation-dissociated 1
  ENSP ID: ENSP00000445794
LIHAGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKAHHMPEAQWLRL

SEQ ID NO: 20812 - protein, 1119 aa, Homo sapiens
  Payload ID: 4204
  Gene Symbol: CAND2
  Gene Name: cullin-associated and neddylation-dissociated 2 (putative)
  Uniprot ID: O75155
  ENSP ID: ENSP00000295989
MSTAAFHISSLLEKMTSSDKDFRFMATSDLMSELQKDSIQLDEDSERKVVKMLLRLLEDKNGEVQNLAVKWLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTQPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 20813 - protein, 1236 aa, Homo sapiens
  Payload ID: 4204
  Gene Symbol: CAND2
  Gene Name: cullin-associated and neddylation-dissociated 2 (putative)
  Uniprot ID: O75155
  ENSP ID: ENSP00000387641
MSTAAFHISSLLEKMTSSDKDFRFMATSDLMSELQKDSIQLDEDSERKVVKMLLRLLEDKNGEVQNLAVKCLGPLVVKVKEYQVETIVDTLCTNMRSDKEQLRDIAGIGLKTVLSELPPAATGSGLATNVCRKITGQLTSAIAQQEDVAVQLEALDILSDMLSRLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTQPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIGEFMESLQDPDLNVRRATLAFFNSAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 20814 - protein, 110 aa, Homo sapiens
  Payload ID: 4204
  Gene Symbol: CAND2
  Gene Name: cullin-associated and neddylation-dissociated 2 (putative)
  ENSP ID: ENSP00000390996
MSTAAFHISSLLEKMTSSDKDFRFMATSDLMSELQKDSIQLDEDSERKVVKMLLRLLEDKNGEVQNLAVKCCRAPLLQGPLSCHNPGKEAGREWGEGRSLAQVARGVRSA

SEQ ID NO: 20815 - protein, 163 aa, Homo sapiens
  Payload ID: 4204
  Gene Symbol: CAND2
  Gene Name: cullin-associated and neddylation-dissociated 2 (putative)
  ENSP ID: ENSP00000403093
MGPFKHTVDDGLDVRKAAFECMYSLLESCLGQLDICEFLNHVEDGLKDHYDIRMLTFIMVARLATLCPAPVLQRVDRLIEPLRATCTAKEPNANSVAWNTQCEDMHALLLGRRLPQHQSQHLPYAPAEAAGLCGRLQWLQDLLPPCLLHFCRGGAADWRGRRP

SEQ ID NO: 20816 - protein, 110 aa, Homo sapiens; identical to SEQ ID NO: 20814
  Payload ID: 4204
  Gene Symbol: CAND2
  Gene Name: cullin-associated and neddylation-dissociated 2 (putative)
  ENSP ID: ENSP00000486760

SEQ ID NO: 20817 - protein, 111 aa, Homo sapiens
  Payload ID: 4205
  Gene Symbol: CUTA
  Gene Name: cutA divalent cation tolerance homolog (E. coli)
  ENSP ID: ENSP00000363608
  MOD_RES (1)..(1): Any amino acid
XSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSM

SEQ ID NO: 20818 - protein, 156 aa, Homo sapiens
  Payload ID: 4205
  Gene Symbol: CUTA
  Gene Name: cutA divalent cation tolerance homolog (E. coli)
  Uniprot ID: O60888
  ENSP ID: ENSP00000363620
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 20819 - protein, 198 aa, Homo sapiens
  Payload ID: 4205
  Gene Symbol: CUTA
  Gene Name: cutA divalent cation tolerance homolog (E. coli)
  Uniprot ID: O60888
  ENSP ID: ENSP00000363624
MIGSGLAGSGGAGGPSSTVTWCALFSNHVAATQASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 20820 - protein, 198 aa, Homo sapiens; identical to SEQ ID NO: 20819
  Payload ID: 4205
  Gene Symbol: CUTA
  Gene Name: cutA divalent cation tolerance homolog (E. coli)
  Uniprot ID: O60888
  ENSP ID: ENSP00000391509

SEQ ID NO: 20821 - protein, 179 aa, Homo sapiens
  Payload ID: 4205
  Gene Symbol: CUTA
  Gene Name: cutA divalent cation tolerance homolog (E. coli)
  Uniprot ID: O60888
  ENSP ID: ENSP00000400114
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 20822 - protein, 156 aa, Homo sapiens; identical to SEQ ID NO: 20818
  Payload ID: 4205
  Gene Symbol: CUTA
  Gene Name: cutA divalent cation tolerance homolog (E. coli)
  Uniprot ID: O60888
  ENSP ID: ENSP00000403268

SEQ ID NO: 20823 - protein, 179 aa, Homo sapiens; identical to SEQ ID NO: 20821
  Payload ID: 4205
  Gene Symbol: CUTA
  Gene Name: cutA divalent cation tolerance homolog (E. coli)
  Uniprot ID: O60888
  ENSP ID: ENSP00000417544

SEQ ID NO: 20824 - protein, 42 aa, Homo sapiens
  Payload ID: 4205
  Gene Symbol: CUTA
  Gene Name: cutA divalent cation tolerance homolog (E. coli)
  ENSP ID: ENSP00000417823
MSGGRAPAVLLGGVVSDRPRPAPSGPRSLDRYPHPKSQRLAP

SEQ ID NO: 20825 - protein, 155 aa, Homo sapiens
  Payload ID: 4205
  Gene Symbol: CUTA
  Gene Name: cutA divalent cation tolerance homolog (E. coli)
  ENSP ID: ENSP00000418612
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMFCAPLRSGRGNCIACGTGELSVPAVGAPGHRVSF

SEQ ID NO: 20826 - protein, 135 aa, Homo sapiens
  Payload ID: 4205
  Gene Symbol: CUTA
  Gene Name: cutA divalent cation tolerance homolog (E. coli)
  ENSP ID: ENSP00000418659
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAESCHDEPCSCSS

SEQ ID NO: 20827 - protein, 156 aa, Homo sapiens; identical to SEQ ID NO: 20818
  Payload ID: 4205
  Gene Symbol: CUTA
  Gene Name: cutA divalent cation tolerance homolog (E. coli)
  Uniprot ID: O60888
  ENSP ID: ENSP00000432744

SEQ ID NO: 20828 - protein, 42 aa, Homo sapiens; identical to SEQ ID NO: 20824
  Payload ID: 4205
  Gene Symbol: CUTA
  Gene Name: cutA divalent cation tolerance homolog (E. coli)
  ENSP ID: ENSP00000433963

SEQ ID NO: 20829 - protein, 111 aa, Homo sapiens; identical to SEQ ID NO: 20817
  Payload ID: 4205
  Gene Symbol: CUTA
  Gene Name: cutA divalent cation tolerance homolog (E. coli)
  ENSP ID: ENSP00000434163
  MOD_RES (1)..(1): Any amino acid

SEQ ID NO: 20830 - protein, 156 aa, Homo sapiens; identical to SEQ ID NO: 20818
  Payload ID: 4205
  Gene Symbol: CUTA
  Gene Name: cutA divalent cation tolerance homolog (E. coli)
  Uniprot ID: O60888
  ENSP ID: ENSP00000475963

SEQ ID NO: 20831 - protein, 156 aa, Homo sapiens; identical to SEQ ID NO: 20818
  Payload ID: 4205
  Gene Symbol: CUTA
  Gene Name: cutA divalent cation tolerance homolog (E. coli)
  Uniprot ID: O60888
  ENSP ID: ENSP00000480360

SEQ ID NO: 20832 - protein, 745 aa, Homo sapiens
  Payload ID: 4206
  Gene Symbol: CTAGE1
  Gene Name: cutaneous T-cell lymphoma-associated antigen 1
  Uniprot ID: Q96RT6
  ENSP ID: ENSP00000375220
MRPDSHPYGFPWELVIRAAVAGFFAVLFLWRSFRSVTSRLYVRREKKFAVALSGLIEEKCKLLEKFSLVQKEYEGYEVESSLKNASFEKEATEAQSLEATCEKLNRFNSELVHEILCLEKELKEEKSKHSEQNELMADISKRIQSLEDESKSLKSQVAEAKMTFKRFQANEERLEIEIQDAWKENSELQESQKQLLQEAEVWKEQVSELIKQKRTFEDSKVHAEQVLNDKENHIKTLTERLLKMKDGVAMLEEDVTDDDNLELEMNSESEDGAYLDNPPKGALKKLIHAAKLNASLKTLEGERNQIYIQLSEVDKTKEELTEHIKNLQTEQASLQSENTHFESENQKLQQKLKVMTELYQENEMKLYRKLIVEEKCRLEKEEKLSKVDEMISHATEELETYRKRAKDLKEFEKTIHFYQKKIILHEKKAHDNWSAAWTAERNLNDLRKENAHNRQKLTEIEFKIKLLEKDPYGLDVPNTAFGRQHSPYGPSPLGWPSSETRASLYPPTLLEGPLRLSPLLPRGGGRGSRGPGNPPDHQITKERGESSCDRLTDPHRAPSDAGPLAPPWEQDYRMMFPPPGQSYPDSALPPQRQDRFYSNCARLSGPAELRSFNMPSLDKMDGSMPSEMESSRNDTKDNLGNLKVPDSSLPAENEATGPGFVPPPLAPIRGLLFPVDTRGPFIRRGPPFPPPPPGTVFGASPDYFSPRDVPGPPRAPFAMRNVYLPRGFLPYRPPRPAFFPPAPTF

SEQ ID NO: 20833 - protein, 74 aa, Homo sapiens
  Payload ID: 4206
  Gene Symbol: CTAGE1
  Gene Name: cutaneous T-cell lymphoma-associated antigen 1
  Uniprot ID: Q9HC47
  ENSP ID: ENSP00000436900
MFVIISLHNCVVISFVLFLFGGNNFIQNFYLPQNYIDQFLLTSFPTFTSVGVLIVLVLCSAFLLLWQGEGVNLR

SEQ ID NO: 20834 - protein, 745 aa, Homo sapiens; identical to SEQ ID NO: 20832
  Payload ID: 4206
  Gene Symbol: CTAGE1
  Gene Name: cutaneous T-cell lymphoma-associated antigen 1
  ENSP ID: ENSP00000489019

SEQ ID NO: 20835 - protein, 74 aa, Homo sapiens; identical to SEQ ID NO: 20833
  Payload ID: 4206
  Gene Symbol: CTAGE1
  Gene Name: cutaneous T-cell lymphoma-associated antigen 1
  ENSP ID: ENSP00000489506

SEQ ID NO: 20836 - protein, 144 aa, Homo sapiens
  Payload ID: 4207
  Gene Symbol: CUTC
  Gene Name: cutC copper transporter
  ENSP ID: ENSP00000359503
MGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDR

SEQ ID NO: 20837 - protein, 273 aa, Homo sapiens
  Payload ID: 4207
  Gene Symbol: CUTC
  Gene Name: cutC copper transporter
  Uniprot ID: Q9NTM9
  ENSP ID: ENSP00000359507
MKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQAKGRIVVMPGGGITDRNLQRILEGSGATEFHCSARSTRDSGMKFRNSSVAMGASLSCSEYSLKVTDVTKVRTLNAIAKNILV

SEQ ID NO: 20838 - protein, 194 aa, Homo sapiens
  Payload ID: 4207
  Gene Symbol: CUTC
  Gene Name: cutC copper transporter
  ENSP ID: ENSP00000433900
MKRQGASSERKRARIPSGKAGAANGFLMEVCVDSVESAVNAERGGADRIELCSGLSEGGTTPSMGVLQVVKQSVQIPVFVMIRPRGGDFLYSDREIEVMKADIRLAKLYGADGLVFGALTEDGHIDKELCMSLMAICRPLPVTFHRAFDMVHDPMAALETLLTLGFERVLTSGCDSSALEGLPLIKRLIEQEVV

SEQ ID NO: 20839 - protein, 1505 aa, Homo sapiens
  Payload ID: 4208
  Gene Symbol: CUX1
  Gene Name: cut-like homeobox 1
  Uniprot ID: P39880
  ENSP ID: ENSP00000292535
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20840 - protein, 678 aa, Homo sapiens
  Payload ID: 4208
  Gene Symbol: CUX1
  Gene Name: cut-like homeobox 1
  Uniprot ID: Q13948
  ENSP ID: ENSP00000292538
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 20841 - protein, 1516 aa, Homo sapiens
  Payload ID: 4208
  Gene Symbol: CUX1
  Gene Name: cut-like homeobox 1
  Uniprot ID: P39880
  ENSP ID: ENSP00000353401
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20842 - protein, 639 aa, Homo sapiens
  Payload ID: 4208
  Gene Symbol: CUX1
  Gene Name: cut-like homeobox 1
  Uniprot ID: Q13948
  ENSP ID: ENSP00000377410
MAANVGSMFQYWKRFDLQQLQDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 20843 - protein, 632 aa, Homo sapiens
  Payload ID: 4208
  Gene Symbol: CUX1
  Gene Name: cut-like homeobox 1
  Uniprot ID: P39880
  ENSP ID: ENSP00000409745
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 20844 - protein, 678 aa, Homo sapiens; identical to SEQ ID NO: 20840
  Payload ID: 4208
  Gene Symbol: CUX1
  Gene Name: cut-like homeobox 1
  Uniprot ID: Q13948
  ENSP ID: ENSP00000414091

SEQ ID NO: 20845 - protein, 1483 aa, Homo sapiens
  Payload ID: 4208
  Gene Symbol: CUX1
  Gene Name: cut-like homeobox 1
  Uniprot ID: P39880
  ENSP ID: ENSP00000446630
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20846 - protein, 1449 aa, Homo sapiens
  Payload ID: 4208
  Gene Symbol: CUX1
  Gene Name: cut-like homeobox 1
  Uniprot ID: P39880
  ENSP ID: ENSP00000447373
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20847 - protein, 662 aa, Homo sapiens
  Payload ID: 4208
  Gene Symbol: CUX1
  Gene Name: cut-like homeobox 1
  Uniprot ID: Q13948
  ENSP ID: ENSP00000449371
MAANVGSMFQYWKRFDLQQLQRELDATATVLANRQDESEQSRKRLIEQSREFKKNTPEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 20848 - protein, 1403 aa, Homo sapiens
  Payload ID: 4208
  Gene Symbol: CUX1
  Gene Name: cut-like homeobox 1
  Uniprot ID: P39880
  ENSP ID: ENSP00000450125
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20849 - protein, 1347 aa, Homo sapiens
  Payload ID: 4208
  Gene Symbol: CUX1
  Gene Name: cut-like homeobox 1
  Uniprot ID: P39880
  ENSP ID: ENSP00000451558
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 20850 - protein, 676 aa, Homo sapiens
  Payload ID: 4208
  Gene Symbol: CUX1
  Gene Name: cut-like homeobox 1
  Uniprot ID: Q13948
  ENSP ID: ENSP00000484760
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 20851 - protein, 1486 aa, Homo sapiens
  Payload ID: 4209
  Gene Symbol: CUX2
  Gene Name: cut-like homeobox 2
  Uniprot ID: O14529
  ENSP ID: ENSP00000261726
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRVERAANREEALEWEF

SEQ ID NO: 20852 - protein, 251 aa, Homo sapiens
  Payload ID: 4209
  Gene Symbol: CUX2
  Gene Name: cut-like homeobox 2
  ENSP ID: ENSP00000380765
MCSPHMGEQDWTCRDPGWEQNLRQLRVLWEGNGFIAAFRFYFCTFAFYLPVVLLTGPRSGAVSGHFWEPWTALERRQELPRKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQE

SEQ ID NO: 20853 - protein, 229 aa, Homo sapiens
  Payload ID: 4210
  Gene Symbol: CWC15
  Gene Name: CWC15 spliceosome-associated protein
  Uniprot ID: Q9P013
  ENSP ID: ENSP00000475615
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPAANLDADDPLTDEEDEDFEEESDDDDTAALLAELEKIKKERAEEQARKEQEQKAEEERIRMENILSGNPLLNLTGPSQPQANFKVKRRWDDDVVFKNCAKGVDDQKKDKRFVNDTLRSEFHKKFMEKYIK

SEQ ID NO: 20854 - protein, 745 aa, Homo sapiens
  Payload ID: 4211
  Gene Symbol: CWC22
  Gene Name: CWC22 spliceosome-associated protein
  ENSP ID: ENSP00000384159
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQK

SEQ ID NO: 20855 - protein, 908 aa, Homo sapiens
  Payload ID: 4211
  Gene Symbol: CWC22
  Gene Name: CWC22 spliceosome-associated protein
  Uniprot ID: Q9HCG8
  ENSP ID: ENSP00000387006
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQKERRQEHGHQETRTERERRSEKHRDQNSSGSNWRDPITKYTSDKDVPSERNNYSRVANDRDQEMHIDLENKHGDPKKKRGERRNSFSENEKHTHRIKDSENFRRKDRSKSKEMNRKHSGSRSDEDRYQNGAERRWEKSSRYSEQSRESKKNQDRRREKSPAKQK

SEQ ID NO: 20856 - protein, 425 aa, Homo sapiens
  Payload ID: 4212
  Gene Symbol: CWC25
  Gene Name: CWC25 spliceosome-associated protein homolog
  Uniprot ID: Q9NXE8
  ENSP ID: ENSP00000477799
MGGGDLNLKKSWHPQTLRNVEKVWKAEQKHEAERKKIEELQRELREERAREEMQRYAEDVGAVKKKEEKLDWMYQGPGGMVNRDEYLLGRPIDKYVFEKMEEKEAGCSSETGLLPGSIFAPSGANSLLDMASKIREDPLFIIRKKEEEKKREVLNNPVKMKKIKELLQMSLEKKEKKKKKEKKKKHKKHKHRSSSSDRSSSEDEHSAGRSQKKMANSSPVLSKVPGYGLQVRNSDRNQGLQGPLTAEQKRGHGMKNHSRSRSSSHSPPRHASKKSTREAGSRDRRSRSLGRRSRSPRPSKLHNSKVNRRETGQTRSPSPKKEVYQRRHAPGYTRKLSAEELERKRQEMMENAKWREEERLNILKRHAKDEEREQRLEKLDSRDGKFIHRMKLESASTSSLEDRVKRNIYSLQRTSVALEKNFMKR

SEQ ID NO: 20857 - protein, 425 aa, Homo sapiens; identical to SEQ ID NO: 20856
  Payload ID: 4212
  Gene Symbol: CWC25
  Gene Name: CWC25 spliceosome-associated protein homolog
  Uniprot ID: Q9NXE8
  ENSP ID: ENSP00000478070

SEQ ID NO: 20858 - protein, 3 aa, Homo sapiens
  Payload ID: 4212
  Gene Symbol: CWC25
  Gene Name: CWC25 spliceosome-associated protein homolog
  ENSP ID: ENSP00000478244
  MOD_RES (1)..(1): Any amino acid
XWK

SEQ ID NO: 20859 - protein, 59 aa, Homo sapiens
  Payload ID: 4212
  Gene Symbol: CWC25
  Gene Name: CWC25 spliceosome-associated protein homolog
  ENSP ID: ENSP00000479527
LQMSLEKKEKKKKKEKKKKHKKHKHRSSSSDRSSSEDEHSAGRHEHLPCAGSCQVLGIQ

SEQ ID NO: 20860 - protein, 68 aa, Homo sapiens
  Payload ID: 4212
  Gene Symbol: CWC25
  Gene Name: CWC25 spliceosome-associated protein homolog
  ENSP ID: ENSP00000481539
MGGGDLNLKKSWHPQTLRNVEKVWKAEQKHEAERKKIEELQRELREERAREEMQRYAEDVGAVKSSWK

SEQ ID NO: 20861 - protein, 68 aa, Homo sapiens; identical to SEQ ID NO: 20860
  Payload ID: 4212
  Gene Symbol: CWC25
  Gene Name: CWC25 spliceosome-associated protein homolog
  ENSP ID: ENSP00000482247

SEQ ID NO: 20862 - protein, 68 aa, Homo sapiens; identical to SEQ ID NO: 20860
  Payload ID: 4212
  Gene Symbol: CWC25
  Gene Name: CWC25 spliceosome-associated protein homolog
  ENSP ID: ENSP00000487854

SEQ ID NO: 20863 - protein, 3 aa, Homo sapiens
  Payload ID: 4212
  Gene Symbol: CWC25
  Gene Name: CWC25 spliceosome-associated protein homolog
  ENSP ID: ENSP00000488038
  MOD_RES (1)..(1): Any amino acid
XWK

SEQ ID NO: 20864 - protein, 59 aa, Homo sapiens; identical to SEQ ID NO: 20859
  Payload ID: 4212
  Gene Symbol: CWC25
  Gene Name: CWC25 spliceosome-associated protein homolog
  ENSP ID: ENSP00000488629

SEQ ID NO: 20865 - protein, 68 aa, Homo sapiens; identical to SEQ ID NO: 20860
  Payload ID: 4212
  Gene Symbol: CWC25
  Gene Name: CWC25 spliceosome-associated protein homolog
  ENSP ID: ENSP00000488869

SEQ ID NO: 20866 - protein, 472 aa, Homo sapiens
  Payload ID: 4213
  Gene Symbol: CWC27
  Gene Name: CWC27 spliceosome-associated protein homolog
  Uniprot ID: Q6UX04
  ENSP ID: ENSP00000370460
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSEELRKEARQLKRELLAAKQKKVENAAKQAEKRSEEEEAPPDGAVAEYRREKQKYEALRKQQSKKGTSREDQTLALLNQFKSKLTQAIAETPENDIPETEVEDDEGWMSHVLQFEDKSRKVKDASMQDSDTFEIYDPRNPVNKRRREESKKLMREKKERR

SEQ ID NO: 20867 - protein, 381 aa, Homo sapiens
  Payload ID: 4213
  Gene Symbol: CWC27
  Gene Name: CWC27 spliceosome-associated protein homolog
  ENSP ID: ENSP00000426802
MSNIYIQEPPTNGKVLLKTTAGDIDIELWSKEAPKACRNFIQLCLEAYYDNTIFHRVVPGFIVQGGDPTGTGSGGESIYGAPFKDEFHSRLRFNRRGLVAMANAGSHDNGSQFFFTLGRADELNNKHTIFGKVTGDTVYNMLRLSEVDIDDDERPHNPHKIKSCEVLFNPFDDIIPREIKRLKKEKPEEEVKKLKPKGTKNFSLLSFGEEAEEEEEEVNRVSQSMKGKSKSSHDLLKDDPHLSSVPVVESEKGDAPDLVDDGEDESAEHDEYIDGDEKNLMRERIAKKLKKDTSANVKSAGEGEVEKKSVSRSPPSLCLYLDYWIQLSRITQAYTSWYYYGFLDSSLSCVSSASLLLTRHNVYFTLQTHSTDHLAACFFMK

SEQ ID NO: 20868 - protein, 538 aa, Homo sapiens
  Payload ID: 4214
  Gene Symbol: CWF19L1
  Gene Name: CWF19-like 1, cell cycle control (S. pombe)
  Uniprot ID: Q69YN2
  ENSP ID: ENSP00000326411
MAQKPLRLLACGDVEGKFDILFNRVQAIQKKSGNFDLLLCVGNFFGSTQDAEWEEYKTGIKKAPIQTYVLGANNQETVKYFQDADGCELAENITYLGRKGIFTGSSGLQIVYLSGTESLNEPVPGYSFSPKDVSSLRMMLCTTSQFKGVDILLTSPWPKCVGNFGNSSGEVDTKKCGSALVSSLATGLKPRYHFAALEKTYYERLPYRNHIILQENAQHATRFIALANVGNPEKKKYLYAFSIVPMKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQVIPVPISCSTTDDIKDAFITQAQEQQIELLEIPEHSDIKQIAQPGAAYFYVELDTGEKLFHRIKKNFPLQFGREVLASEAILNVPDKSDWRQCQISKEDEETLARRFRKDFEPYDFTLDD

SEQ ID NO: 20869 - protein, 253 aa, Homo sapiens
  Payload ID: 4214
  Gene Symbol: CWF19L1
  Gene Name: CWF19-like 1, cell cycle control (S. pombe)
  ENSP ID: ENSP00000359405
MKLMDAAELVKQPPDVTENPYRKSGQEASIGKQILAPVEESACQFFFDLNEKQGRKRSSTGRDSKSSPHPKQPRKPPQPPGPCWFCLASPEVEKHLVVNIGTHCYLALAKGGLSDDHVLILPIGHYQSVVELSAEVVEEVEKYKATLRRFFKSRGKWCVVFERNYKSHHLQLQIAQPGAAYFYVELDTGEKLFHRIKKNFPLQFGREVLASEAILNVPDKSDWRQCQISKEDEETLARRFRKDFEPYDFTLDD

SEQ ID NO: 20870 - protein, 894 aa, Homo sapiens
  Payload ID: 4215
  Gene Symbol: CWF19L2
  Gene Name: CWF19-like 2, cell cycle control (S. pombe)
  Uniprot ID: Q2TBE0
  ENSP ID: ENSP00000282251
MATSMAAASGRFESAKSIEERKEQTRNARAEVLRQAKANFEKEERRKELKRLRGEDTWMLPDVNERIEQFSQEHSVKKKKKKDKHSKKAKKEKKKKSKKQKYEKNNESSDSSSSSEDEWVEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQMFRKSLVKMFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQHKFPHYFGKEIIGGMLDIEPRLWRKGIRESFEDQRKKALQFAQWWKPYDFTKSKNY

SEQ ID NO: 20871 - protein, 623 aa, Homo sapiens
  Payload ID: 4215
  Gene Symbol: CWF19L2
  Gene Name: CWF19-like 2, cell cycle control (S. pombe)
  ENSP ID: ENSP00000411736
VEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQIKSRTVIQ

SEQ ID NO: 20872 - protein, 553 aa, Homo sapiens
  Payload ID: 4215
  Gene Symbol: CWF19L2
  Gene Name: CWF19-like 2, cell cycle control (S. pombe)
  ENSP ID: ENSP00000434704
VEAVPSQTPDKEKAWKVKDEKSGKDDTQIIKRDEWMTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKQLRENVLVKRKRTKGKKLLLSIGVLLHKWKNVCIVLTALNFPSILLLQ

SEQ ID NO: 20873 - protein, 47 aa, Homo sapiens
  Payload ID: 4216
  Gene Symbol: CMC1
  Gene Name: C-x(9)-C motif containing 1
  ENSP ID: ENSP00000334960
MALDPAGTGAGSGVCRGASPRVSRRGPCGLDADLGKTSISDMSKKMF

SEQ ID NO: 20874 - protein, 76 aa, Homo sapiens
  Payload ID: 4216
  Gene Symbol: CMC1
  Gene Name: C-x(9)-C motif containing 1
  ENSP ID: ENSP00000404581
MALDPADFTKCCKNSGVLMVVKCRKENSALKECLTAYYNDPAFYEECKMEYLKEREEFRKTGIPTKKRLQKLPTSM

SEQ ID NO: 20875 - protein, 113 aa, Homo sapiens
  Payload ID: 4216
  Gene Symbol: CMC1
  Gene Name: C-x(9)-C motif containing 1
  ENSP ID: ENSP00000411302
  MOD_RES (1)..(1): Any amino acid
XRVNSSTKLSSGANQHLRHVEKDVLIPKIMREKAKERCSEQVQDFTKCCKNSGVLMVVKCRKENSALKECLTAYYNDPAFYEECKMEYLKEREEFRKTGIPTKKRLQKLPTSM

SEQ ID NO: 20876 - protein, 106 aa, Homo sapiens
  Payload ID: 4216
  Gene Symbol: CMC1
  Gene Name: C-x(9)-C motif containing 1
  Uniprot ID: Q7Z7K0
  ENSP ID: ENSP00000418348
MALDPADQHLRHVEKDVLIPKIMREKAKERCSEQVQDFTKCCKNSGVLMVVKCRKENSALKECLTAYYNDPAFYEECKMEYLKEREEFRKTGIPTKKRLQKLPTSM

SEQ ID NO: 20877 - protein, 79 aa, Homo sapiens
  Payload ID: 4217
  Gene Symbol: CMC2
  Gene Name: C-x(9)-C motif containing 2
  Uniprot ID: Q9NRP2
  ENSP ID: ENSP00000219400
MHPDLSPHLHTEECNVLINLLKECHKNHNILKFFGYCNDVDRELRKCLKNEYVENRTKSREHGIAMRKKLFNPPEESEK

SEQ ID NO: 20878 - protein, 55 aa, Homo sapiens
  Payload ID: 4217
  Gene Symbol: CMC2
  Gene Name: C-x(9)-C motif containing 2
  ENSP ID: ENSP00000454240
MHPDLSPHLHTEECNVLINLLKECHKNYVENRTKSREHGIAMRKKLFNPPEESEK

SEQ ID NO: 20879 - protein, 74 aa, Homo sapiens
  Payload ID: 4217
  Gene Symbol: CMC2
  Gene Name: C-x(9)-C motif containing 2
  ENSP ID: ENSP00000454396
MHPDLSPHLHTEECNVLINLLKECHKNHNILKFFGYCNDVDRELRKCLKNEVLALSPKLECSRVIVTHGSLKLK

SEQ ID NO: 20880 - protein, 36 aa, Homo sapiens
  Payload ID: 4217
  Gene Symbol: CMC2
  Gene Name: C-x(9)-C motif containing 2
  ENSP ID: ENSP00000454658
MHPDLSPHLHTEECNVLINLLKECHKNDSVQDTHYT

SEQ ID NO: 20881 - protein, 51 aa, Homo sapiens
  Payload ID: 4217
  Gene Symbol: CMC2
  Gene Name: C-x(9)-C motif containing 2
  ENSP ID: ENSP00000454709
MHPDLSPHLHTEECNVLINLLKECHKNGTRTVIFSADTSDYNGIILKVSAL

SEQ ID NO: 20882 - protein, 74 aa, Homo sapiens; identical to SEQ ID NO: 20879
  Payload ID: 4217
  Gene Symbol: CMC2
  Gene Name: C-x(9)-C motif containing 2
  ENSP ID: ENSP00000454938

SEQ ID NO: 20883 - protein, 51 aa, Homo sapiens; identical to SEQ ID NO: 20881
  Payload ID: 4217
  Gene Symbol: CMC2
  Gene Name: C-x(9)-C motif containing 2
  ENSP ID: ENSP00000455177

SEQ ID NO: 20884 - protein, 55 aa, Homo sapiens; identical to SEQ ID NO: 20878
  Payload ID: 4217
  Gene Symbol: CMC2
  Gene Name: C-x(9)-C motif containing 2
  ENSP ID: ENSP00000455404

SEQ ID NO: 20885 - protein, 79 aa, Homo sapiens; identical to SEQ ID NO: 20877
  Payload ID: 4217
  Gene Symbol: CMC2
  Gene Name: C-x(9)-C motif containing 2
  Uniprot ID: Q9NRP2
  ENSP ID: ENSP00000455457

SEQ ID NO: 20886 - protein, 79 aa, Homo sapiens; identical to SEQ ID NO: 20877
  Payload ID: 4217
  Gene Symbol: CMC2
  Gene Name: C-x(9)-C motif containing 2
  Uniprot ID: Q9NRP2
  ENSP ID: ENSP00000455723

SEQ ID NO: 20887 - protein, 54 aa, Homo sapiens
  Payload ID: 4217
  Gene Symbol: CMC2
  Gene Name: C-x(9)-C motif containing 2
  ENSP ID: ENSP00000455880
  MOD_RES (1)..(1): Any amino acid
XLHTEECNVLINLLKECHKNHNILKFFGYCNDVDRELRKCLKNEGPSGLPLEMS

SEQ ID NO: 20888 - protein, 50 aa, Homo sapiens
  Payload ID: 4217
  Gene Symbol: CMC2
  Gene Name: C-x(9)-C motif containing 2
  ENSP ID: ENSP00000456177
MHPDLSPHLHTEECNVLINLLKECHKNVLALSPKLECSRVIVTHGSLKLK

SEQ ID NO: 20889 - protein, 79 aa, Homo sapiens; identical to SEQ ID NO: 20877
  Payload ID: 4217
  Gene Symbol: CMC2
  Gene Name: C-x(9)-C motif containing 2
  Uniprot ID: Q9NRP2
  ENSP ID: ENSP00000456841

SEQ ID NO: 20890 - protein, 93 aa, Homo sapiens
  Payload ID: 4217
  Gene Symbol: CMC2
  Gene Name: C-x(9)-C motif containing 2
  ENSP ID: ENSP00000457106
MHPDLSPHLHTEECNVLINLLKECHKNETCIISATYSVQKKSSGVYHNILKFFGYCNDVDRELRKCLKNEVLALSPKLECSRVIVTHGSLKLK

SEQ ID NO: 20891 - protein, 74 aa, Homo sapiens; identical to SEQ ID NO: 20879
  Payload ID: 4217
  Gene Symbol: CMC2
  Gene Name: C-x(9)-C motif containing 2
  ENSP ID: ENSP00000457938

SEQ ID NO: 20892 - protein, 93 aa, Homo sapiens; identical to SEQ ID NO: 20890
  Payload ID: 4217
  Gene Symbol: CMC2
  Gene Name: C-x(9)-C motif containing 2
  ENSP ID: ENSP00000487053

SEQ ID NO: 20893 - protein, 68 aa, Homo sapiens
  Payload ID: 4218
  Gene Symbol: CMC4
  Gene Name: C-x(9)-C motif containing 4
  Uniprot ID: P56277
  ENSP ID: ENSP00000358491
MPQKDPCQKQACEIQKCLQANSYMESKCQAVIQELRKCCAQYPKGRSVVCSGFEKEEEENLTRKSASK

SEQ ID NO: 20894 - protein, 68 aa, Homo sapiens; identical to SEQ ID NO: 20893
  Payload ID: 4218
  Gene Symbol: CMC4
  Gene Name: C-x(9)-C motif containing 4
  Uniprot ID: P56277
  ENSP ID: ENSP00000358496

SEQ ID NO: 20895 - protein, 373 aa, Homo sapiens
  Payload ID: 4219
  Gene Symbol: CLMP
  Gene Name: CXADR-like membrane protein
  Uniprot ID: Q9H6B4
  ENSP ID: ENSP00000405577
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 20896 - protein, 656 aa, Homo sapiens
  Payload ID: 4220
  Gene Symbol: CXXC1
  Gene Name: CXXC finger protein 1
  Uniprot ID: Q9P0U4
  ENSP ID: ENSP00000285106
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 20897 - protein, 660 aa, Homo sapiens
  Payload ID: 4220
  Gene Symbol: CXXC1
  Gene Name: CXXC finger protein 1
  Uniprot ID: Q9P0U4
  ENSP ID: ENSP00000390475
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKVMERKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGATRLFCDVYNPQSKTYCKRLQVLCPEHSRDPKVPADEVCGCPLVRDVFELTGDFCRLPKRQCNRHYCWEKLRRAEVDLERVRVWYKLDELFEQERNVRTAMTNRAGLLALMLHQTIQHDPLTTDLRSSADR

SEQ ID NO: 20898 - protein, 231 aa, Homo sapiens
  Payload ID: 4220
  Gene Symbol: CXXC1
  Gene Name: CXXC finger protein 1
  ENSP ID: ENSP00000465284
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSES

SEQ ID NO: 20899 - protein, 250 aa, Homo sapiens
  Payload ID: 4220
  Gene Symbol: CXXC1
  Gene Name: CXXC finger protein 1
  ENSP ID: ENSP00000465849
MHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKVMERKEERYKRHRQKQKHKDKWKHPERADAKDPASLPQCLGPGCVRPAQPSSKYCSDDCGMK

SEQ ID NO: 20900 - protein, 613 aa, Homo sapiens
  Payload ID: 4220
  Gene Symbol: CXXC1
  Gene Name: CXXC finger protein 1
  ENSP ID: ENSP00000467634
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARESYKYFPSSLSPVTPSESLPRPRRPLPTQQQPQPSQKLGRIREDEGAVASSTVKEPPEATATPEPLSDEDLPLDPDLYQDFCAGAFDDHGLPWMSDTEESPFLDPALRKRAVKVKHVKRREKKSEKKKEERYKRHRQKQKHKDKWKHPERADAKDPASLPQCLGPGCVRPAQPSSKYCSDDCGMKLAANRIYEILPQRIQQWQQSPCIAEEHGKKLLERIRREQQSARTRLQEMERRFHELEAIILRAKQQAVREDEESNEGDSDDTDLQIFCVSCGHPINPRVALRHMERCYAKYESQTSFGSMYPTRIEGAKHTVSGSRCCAPSTHGTPKCQLTRYAGAPLYVMSLSSRVTSAACPSASAIAITAGRSCGVRKWTWSACVCGTSWTSCLSRSAMCAQP

SEQ ID NO: 20901 - protein, 252 aa, Homo sapiens
  Payload ID: 4220
  Gene Symbol: CXXC1
  Gene Name: CXXC finger protein 1
  ENSP ID: ENSP00000468038
MEGDGSDPEPPDAGEDSKSENGENAPIYCICRKPDINCFMIGCDNCNEWFHGDCIRITEKMAKAIREWYCRECREKDPKLEIRYRHKKSRERDGNERDSSEPRDEGGGRKRPVPDPDLQRRAGSGTGVGAMLARGSASPHKSSPQPLVATPSQHHQQQQQQIKRSARMCGECEACRRTEDCGHCDFCRDMKKFGGPNKIRQKCRLRQCQLRARLSPVTPSESLPRPRRPLPTQQQPQPSQKLGRIREDEGAV

SEQ ID NO: 20902 - protein, 367 aa, Homo sapiens
  Payload ID: 4221
  Gene Symbol: CXXC4
  Gene Name: CXXC finger protein 4
  ENSP ID: ENSP00000378248
MNTNVCVEPGPSPEAPGLPKESHLPEGALNSLVDYNSEMERYRSFATSFYKTNGGAFPQAAKIARITTPIFPSSAAAAAAAARIGMSPWNCDNAATAAAATAMLWGSGGGGGGGGGGGGGGGGGGGGGGGGGGGRKSSSAAASSSASSSSAILPAGGGGGGGGGGSRTSMHHRNDSQRLGKAGCPPEPSLQMANTNFLSTLSPEHCRPLAGECMNKLKCGAAEAEIMNLPERVGTFSAIPALGGISLPPGVIVMTALHSPAAASAAVTDSAFQIANLADCPQNHSSSSSSSSGGAGGANPAKKKRKRCGVCVPCKRLINCGVCSSCRNRKTGHQICKFRKCEELKKKPGTSLERTPVPSAEAFRWFF

SEQ ID NO: 20903 - protein, 322 aa, Homo sapiens
  Payload ID: 4222
  Gene Symbol: CXXC5
  Gene Name: CXXC finger protein 5
  Uniprot ID: Q7LFL8
  ENSP ID: ENSP00000302543
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 20904 - protein, 83 aa, Homo sapiens
  Payload ID: 4222
  Gene Symbol: CXXC5
  Gene Name: CXXC finger protein 5
  ENSP ID: ENSP00000421057
MSSLGGGSQDAGGSSSSSTNGSGGSGSSGPKAGAADKSAVVAAAAPASVADDTPPPERRNKSGIISEPLNKSLRRSRPLSHYS

SEQ ID NO: 20905 - protein, 8 aa, Homo sapiens
  Payload ID: 4222
  Gene Symbol: CXXC5
  Gene Name: CXXC finger protein 5
  ENSP ID: ENSP00000421866
MSSLGGGS

SEQ ID NO: 20906 - protein, 102 aa, Homo sapiens
  Payload ID: 4222
  Gene Symbol: CXXC5
  Gene Name: CXXC finger protein 5
  ENSP ID: ENSP00000422883
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESA

SEQ ID NO: 20907 - protein, 73 aa, Homo sapiens
  Payload ID: 4222
  Gene Symbol: CXXC5
  Gene Name: CXXC finger protein 5
  ENSP ID: ENSP00000423365
MSSLGGGSQDAGGSSSSSTNGSGGSGSSGPKAGAADKSAVVAAAAPASVADDTPPPERRNKSGIISEPLNKSL

SEQ ID NO: 20908 - protein, 181 aa, Homo sapiens
  Payload ID: 4222
  Gene Symbol: CXXC5
  Gene Name: CXXC finger protein 5
  ENSP ID: ENSP00000424219
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLP

SEQ ID NO: 20909 - protein, 161 aa, Homo sapiens
  Payload ID: 4222
  Gene Symbol: CXXC5
  Gene Name: CXXC finger protein 5
  ENSP ID: ENSP00000425203
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLT

SEQ ID NO: 20910 - protein, 80 aa, Homo sapiens
  Payload ID: 4222
  Gene Symbol: CXXC5
  Gene Name: CXXC finger protein 5
  ENSP ID: ENSP00000426124
MSSLGGGSQDAGGSSSSSTNGSGGSGSSGPKAGAADKSAVVAAAAPASVADDTPPPERRNKSGIISEPLNKSLRRSRPLS

SEQ ID NO: 20911 - protein, 68 aa, Homo sapiens
  Payload ID: 4222
  Gene Symbol: CXXC5
  Gene Name: CXXC finger protein 5
  ENSP ID: ENSP00000427127
MSSLGGGSQDAGGSSSSSTNGSGGSGSSGPKAGAADKSAVVAAAAPASVADDTPPPERRNKSGIISEP

SEQ ID NO: 20912 - protein, 11 aa, Homo sapiens
  Payload ID: 4222
  Gene Symbol: CXXC5
  Gene Name: CXXC finger protein 5
  ENSP ID: ENSP00000427253
MSSLGGGSQDA

SEQ ID NO: 20913 - protein, 322 aa, Homo sapiens; identical to SEQ ID NO: 20903
  Payload ID: 4222
  Gene Symbol: CXXC5
  Gene Name: CXXC finger protein 5
  Uniprot ID: Q7LFL8
  ENSP ID: ENSP00000427379

SEQ ID NO: 20914 - protein, 98 aa, Homo sapiens
  Payload ID: 4222
  Gene Symbol: CXXC5
  Gene Name: CXXC finger protein 5
  ENSP ID: ENSP00000427440
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMG

SEQ ID NO: 20915 - protein, 137 aa, Homo sapiens
  Payload ID: 4222
  Gene Symbol: CXXC5
  Gene Name: CXXC finger protein 5
  ENSP ID: ENSP00000430522
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHK

SEQ ID NO: 20916 - protein, 196 aa, Homo sapiens
  Payload ID: 4222
  Gene Symbol: CXXC5
  Gene Name: CXXC finger protein 5
  ENSP ID: ENSP00000430949
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAV

SEQ ID NO: 20917 - protein, 161 aa, Homo sapiens
  Payload ID: 4223
  Gene Symbol: CNBD1
  Gene Name: cyclic nucleotide binding domain containing 1
  ENSP ID: ENSP00000427742
  MOD_RES (1)..(1): Any amino acid
XGCCNIYRSIIGFVKLRSNKVKRSQKLVYMGKLKEKESFGEISVLLQVPFTCTIITKKEVEMAIIEDKDLFELDPVTKQLMLQTAKPTFGHLTDEDVKNEYLKKEQQKEWKDFKIASWTKEITDFICLYEKHQDNFTLPKIAHLERITKRIKNNSILIHLE

SEQ ID NO: 20918 - protein, 436 aa, Homo sapiens
  Payload ID: 4223
  Gene Symbol: CNBD1
  Gene Name: cyclic nucleotide binding domain containing 1
  Uniprot ID: Q8NA66
  ENSP ID: ENSP00000430073
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFVA

SEQ ID NO: 20919 - protein, 207 aa, Homo sapiens
  Payload ID: 4223
  Gene Symbol: CNBD1
  Gene Name: cyclic nucleotide binding domain containing 1
  ENSP ID: ENSP00000430986
  MOD_RES (1)..(1): Any amino acid
XNMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFELDPVTKQLMLQTAKPTFGHLTDEDVKNEYLKKEQQKEWKDFKDKTVKNSLYYKGIIPGFGKWDHYCTSIPRNLKDTLVNY

SEQ ID NO: 20920 - protein, 292 aa, Homo sapiens [sequence omitted]

SEQ ID NO: 20921 - protein, 572 aa, Homo sapiens
  Payload ID: 4224
  Gene Symbol: CNBD2
  Gene Name: cyclic nucleotide binding domain containing 2
  Uniprot ID: Q96M20
  ENSP ID: ENSP00000340954
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEILAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 20922 - protein, 576 aa, Homo sapiens
  Payload ID: 4224
  Gene Symbol: CNBD2
  Gene Name: cyclic nucleotide binding domain containing 2
  Uniprot ID: Q96M20
  ENSP ID: ENSP00000363084
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEILGLHQAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 20923 - protein, 423 aa, Homo sapiens
  Payload ID: 4224
  Gene Symbol: CNBD2
  Gene Name: cyclic nucleotide binding domain containing 2
  Uniprot ID: Q96M20
  ENSP ID: ENSP00000442729
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLPKMLGPKIQSRPAQSIKCAMINIKPGELPKEAAVGAYVKVHTVEQGEIL

SEQ ID NO: 20924 - protein, 144 aa, Homo sapiens
  Payload ID: 4224
  Gene Symbol: CNBD2
  Gene Name: cyclic nucleotide binding domain containing 2
  ENSP ID: ENSP00000476014
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERKWTFCMLQ

SEQ ID NO: 20925 - protein, 25 aa, Homo sapiens
  Payload ID: 4224
  Gene Symbol: CNBD2
  Gene Name: cyclic nucleotide binding domain containing 2
  ENSP ID: ENSP00000478833
  MOD_RES (1)..(1): Any amino acid
XDFKSRTLSVRRFGLQVTFACGRPF

SEQ ID NO: 20926 - protein, 181 aa, Homo sapiens
  Payload ID: 4224
  Gene Symbol: CNBD2
  Gene Name: cyclic nucleotide binding domain containing 2
  ENSP ID: ENSP00000479333
MRRLLPSRCGRASCAWPGLLPNGGASERQFEEESEEEPECLEIDFKSRTLSVRRFGLQIEKPRCQKMKDWSKIRKLGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAE

SEQ ID NO: 20927 - protein, 100 aa, Homo sapiens
  Payload ID: 4224
  Gene Symbol: CNBD2
  Gene Name: cyclic nucleotide binding domain containing 2
  ENSP ID: ENSP00000480804
MRRHMVTYAWQLLKKELGLYQLAMDIIIMIRVCKMFRQGLRGFREYQIIETAHWKHPIFSFWDVSSWAQQDYEGSKKPNKLHPTSWPKLRTEKEDKRKSR

SEQ ID NO: 20928 - protein, 690 aa, Homo sapiens
  Payload ID: 4225
  Gene Symbol: CNGA1
  Gene Name: cyclic nucleotide gated channel alpha 1
  Uniprot ID: P29973
  ENSP ID: ENSP00000351320
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 20929 - protein, 759 aa, Homo sapiens
  Payload ID: 4225
  Gene Symbol: CNGA1
  Gene Name: cyclic nucleotide gated channel alpha 1
  Uniprot ID: P29973
  ENSP ID: ENSP00000384264
MESRSSPRLECSGAISAHCSLHLPDSSDFQLIFVFLVEMGFHHVGQAGLELLISSDLPTSASQSAGITDMKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 20930 - protein, 690 aa, Homo sapiens; identical to SEQ ID NO: 20928
  Payload ID: 4225
  Gene Symbol: CNGA1
  Gene Name: cyclic nucleotide gated channel alpha 1
  Uniprot ID: P29973
  ENSP ID: ENSP00000389881

SEQ ID NO: 20931 - protein, 99 aa, Homo sapiens
  Payload ID: 4225
  Gene Symbol: CNGA1
  Gene Name: cyclic nucleotide gated channel alpha 1
  ENSP ID: ENSP00000421110
MKLSMKNNIINTQQSFVTMPNVIVPDIEKEIRRMENGACSSFSEDDDSASTSEESENENPHARGSFSYKSLRKGGPSQREQYLPGAIALFNVNNSSNKD

SEQ ID NO: 20932 - protein, 99 aa, Homo sapiens; identical to SEQ ID NO: 20931
  Payload ID: 4225
  Gene Symbol: CNGA1
  Gene Name: cyclic nucleotide gated channel alpha 1
  ENSP ID: ENSP00000423327

SEQ ID NO: 20933 - protein, 128 aa, Homo sapiens
  Payload ID: 4225
  Gene Symbol: CNGA1
  Gene Name: cyclic nucleotide gated channel alpha 1
  ENSP ID: ENSP00000423721
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEK

SEQ ID NO: 20934 - protein, 690 aa, Homo sapiens; identical to SEQ ID NO: 20928
  Payload ID: 4225
  Gene Symbol: CNGA1
  Gene Name: cyclic nucleotide gated channel alpha 1
  Uniprot ID: P29973
  ENSP ID: ENSP00000426862

SEQ ID NO: 20935 - protein, 759 aa, Homo sapiens; identical to SEQ ID NO: 20929
  Payload ID: 4225
  Gene Symbol: CNGA1
  Gene Name: cyclic nucleotide gated channel alpha 1
  Uniprot ID: P29973
  ENSP ID: ENSP00000443401

SEQ ID NO: 20936 - protein, 664 aa, Homo sapiens
  Payload ID: 4226
  Gene Symbol: CNGA2
  Gene Name: cyclic nucleotide gated channel alpha 2
  Uniprot ID: Q16280
  ENSP ID: ENSP00000328478
MTEKTNGVKSSPANNHNHHAPPAIKANGKDDHRTSSRPHSAADDDTSSELQRLADVDAPQQGRSGFRRIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEVDVQEKLGQLETNMETLYTRFGRLLAEYTGAQQKLKQRITVLETKMKQNNEDDYLSDGMNSPELAAADEP

SEQ ID NO: 20937 - protein, 694 aa, Homo sapiens
  Payload ID: 4227
  Gene Symbol: CNGA3
  Gene Name: cyclic nucleotide gated channel alpha 3
  Uniprot ID: Q16281
  ENSP ID: ENSP00000272602
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 20938 - protein, 694 aa, Homo sapiens; identical to SEQ ID NO: 20937
  Payload ID: 4227
  Gene Symbol: CNGA3
  Gene Name: cyclic nucleotide gated channel alpha 3
  Uniprot ID: Q16281
  ENSP ID: ENSP00000377140

SEQ ID NO: 20939 - protein, 698 aa, Homo sapiens
  Payload ID: 4227
  Gene Symbol: CNGA3
  Gene Name: cyclic nucleotide gated channel alpha 3
  Uniprot ID: Q16281
  ENSP ID: ENSP00000386761
METRGLADSGQGSFTGQGIARFGRIQKKSQPEKVVRAASRGRPLIGWTQWCAEDGGDESEMALAGSPGCSSGPQGRLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 20940 - protein, 676 aa, Homo sapiens
  Payload ID: 4227
  Gene Symbol: CNGA3
  Gene Name: cyclic nucleotide gated channel alpha 3
  Uniprot ID: Q16281
  ENSP ID: ENSP00000410070
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRRKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 20941 - protein, 575 aa, Homo sapiens
  Payload ID: 4228
  Gene Symbol: CNGA4
  Gene Name: cyclic nucleotide gated channel alpha 4
  Uniprot ID: Q8IV77
  ENSP ID: ENSP00000369268
MSQDTKVKTTESSPPAPSKARKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREEEYLFMVGDFLLAVMGFATIMGSMSSVIYNMNTADAAFYPDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGNMSGNRRTANIKSLGYSDLFCLSKEDLREVLSEYPQAQTIMEEKGREILLKMNKLDVNAEAAEIALQEATESRLRGLDQQLDDLQTKFARLLAELESSALKIAYRIERLEWQTREWPMPEDLAEADDEGEPEEGTSKDEEGRASQEGPPGPE

SEQ ID NO: 20942 - protein, 225 aa, Homo sapiens
  Payload ID: 4228
  Gene Symbol: CNGA4
  Gene Name: cyclic nucleotide gated channel alpha 4
  ENSP ID: ENSP00000433399
MVFPVMYNLIILVCRACFPDLQHGYLVAWLVLDYTSDLLYLLDMVVRFHTDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGGYPSICSRDKDGWGRGEQQSPVLGPDSTSGLNF

SEQ ID NO: 20943 - protein, 1251 aa, Homo sapiens
  Payload ID: 4229
  Gene Symbol: CNGB1
  Gene Name: cyclic nucleotide gated channel beta 1
  Uniprot ID: Q14028
  ENSP ID: ENSP00000251102
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 20944 - protein, 299 aa, Homo sapiens
  Payload ID: 4229
  Gene Symbol: CNGB1
  Gene Name: cyclic nucleotide gated channel beta 1
  Uniprot ID: Q14028
  ENSP ID: ENSP00000311670
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTRVMGAGGL

SEQ ID NO: 20945 - protein, 1245 aa, Homo sapiens
  Payload ID: 4229
  Gene Symbol: CNGB1
  Gene Name: cyclic nucleotide gated channel beta 1
  Uniprot ID: Q14028
  ENSP ID: ENSP00000454633
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 20946 - protein, 214 aa, Homo sapiens
  Payload ID: 4229
  Gene Symbol: CNGB1
  Gene Name: cyclic nucleotide gated channel beta 1
  ENSP ID: ENSP00000455708
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPS

SEQ ID NO: 20947 - protein, 126 aa, Homo sapiens
  Payload ID: 4229
  Gene Symbol: CNGB1
  Gene Name: cyclic nucleotide gated channel beta 1
  ENSP ID: ENSP00000455964
  MOD_RES (1)..(1): Any amino acid
XNDYVCKKGEIGREMYIIQAGQVQVLGGPDGKSVLVTLKAGSVFGEISLLAVGGGNRRTANVVAHGFTNLFILDKKDLNEILVHYPESQKLLRKKARPRARKTSRERKAPPPQTSTRTQRRPPPTH

SEQ ID NO: 20948 - protein, 809 aa, Homo sapiens
  Payload ID: 4230
  Gene Symbol: CNGB3
  Gene Name: cyclic nucleotide gated channel beta 3
  Uniprot ID: Q9NQW8
  ENSP ID: ENSP00000316605
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 20949 - protein, 111 aa, Homo sapiens
  Payload ID: 4230
  Gene Symbol: CNGB3
  Gene Name: cyclic nucleotide gated channel beta 3
  ENSP ID: ENSP00000428329
AHGFANLLTLDKKTLQEILVHYPDSERILMKKARVLLKQKAKTAEATPPRKDLALLFPPKEETPKLFKTLLGGTGKASLARLLKLKREQAAQGQFLPVSFTAGIFLGHLRL

SEQ ID NO: 20950 - protein, 465 aa, Homo sapiens
  Payload ID: 4231
  Gene Symbol: CCNA1
  Gene Name: cyclin A1
  Uniprot ID: P78396
  ENSP ID: ENSP00000255465
METGFPAIMYPGSFIGGWGEEYLSWEGPGLPDFVFQQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 20951 - protein, 421 aa, Homo sapiens
  Payload ID: 4231
  Gene Symbol: CCNA1
  Gene Name: cyclin A1
  Uniprot ID: P78396
  ENSP ID: ENSP00000400666
MHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 20952 - protein, 464 aa, Homo sapiens
  Payload ID: 4231
  Gene Symbol: CCNA1
  Gene Name: cyclin A1
  Uniprot ID: P78396
  ENSP ID: ENSP00000486017
METGFPAIMYPGSFIGGWGEEYLSWEGPGLPDFVFQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 20953 - protein, 421 aa, Homo sapiens; identical to SEQ ID NO: 20951
  Payload ID: 4231
  Gene Symbol: CCNA1
  Gene Name: cyclin A1
  Uniprot ID: P78396
  ENSP ID: ENSP00000486482

SEQ ID NO: 20954 - protein, 432 aa, Homo sapiens
  Payload ID: 4232
  Gene Symbol: CCNA2
  Gene Name: cyclin A2
  Uniprot ID: P20248
  ENSP ID: ENSP00000274026
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIILEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 20955 - protein, 432 aa, Homo sapiens; identical to SEQ ID NO: 20954
  Payload ID: 4232
  Gene Symbol: CCNA2
  Gene Name: cyclin A2
  Uniprot ID: P20248
  ENSP ID: ENSP00000481380

SEQ ID NO: 20956 - protein, 951 aa, Homo sapiens
  Payload ID: 4233
  Gene Symbol: CNNM1
  Gene Name: cyclin and CBS domain divalent metal cation transport mediator 1
  Uniprot ID: Q9NRU3
  ENSP ID: ENSP00000349147
MAAAAAAAAAVGVRLRDCCSRGAVLLLFFSLSPRPPAAAAWLLGLRPEDTAGGRVSLEGGTLRAAEGTSFLLRVYFQPGPPATAAPVPSPTLNSGENGTGDWAPRLVFIEEPPGGGGVAPSAVPTRPPGPQRCREQSDWASDVEVLGPLRPGGVAGSALVQVRVRELRKGEAERGGAGGGGKLFSLCAWDGRAWHHHGAAGGFLLRVRPRLYGPGGDLLPPAWLRALGALLLLALSALFSGLRLSLLSLDPVELRVLRNSGSAAEQEQARRVQAVRGRGTHLLCTLLLGQAGANAALAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 20957 - protein, 552 aa, Homo sapiens
  Payload ID: 4234
  Gene Symbol: CNNM2
  Gene Name: cyclin and CBS domain divalent metal cation transport mediator 2
  Uniprot ID: Q9H8M5
  ENSP ID: ENSP00000358891
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKEHTNKKPKSYQH

SEQ ID NO: 20958 - protein, 875 aa, Homo sapiens
  Payload ID: 4234
  Gene Symbol: CNNM2
  Gene Name: cyclin and CBS domain divalent metal cation transport mediator 2
  Uniprot ID: Q9H8M5
  ENSP ID: ENSP00000358894
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPVPLSLSRTFVVSRTELLAAGSPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 20959 - protein, 853 aa, Homo sapiens
  Payload ID: 4234
  Gene Symbol: CNNM2
  Gene Name: cyclin and CBS domain divalent metal cation transport mediator 2
  Uniprot ID: Q9H8M5
  ENSP ID: ENSP00000392875
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 20960 - protein, 707 aa, Homo sapiens
  Payload ID: 4235
  Gene Symbol: CNNM3
  Gene Name: cyclin and CBS domain divalent metal cation transport mediator 3
  Uniprot ID: Q8NE01
  ENSP ID: ENSP00000305449
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 20961 - protein, 659 aa, Homo sapiens
  Payload ID: 4235
  Gene Symbol: CNNM3
  Gene Name: cyclin and CBS domain divalent metal cation transport mediator 3
  Uniprot ID: Q8NE01
  ENSP ID: ENSP00000366260
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 20962 - protein, 775 aa, Homo sapiens
  Payload ID: 4236
  Gene Symbol: CNNM4
  Gene Name: cyclin and CBS domain divalent metal cation transport mediator 4
  Uniprot ID: Q6P4Q7
  ENSP ID: ENSP00000366275
MAPVGGGGRPVGGPARGRLLLAAPVLLVLLWALGARGQGSPQQGTIVGMRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 20963 - protein, 433 aa, Homo sapiens
  Payload ID: 4237
  Gene Symbol: CCNB1
  Gene Name: cyclin B1
  Uniprot ID: P14635
  ENSP ID: ENSP00000256442
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 20964 - protein, 401 aa, Homo sapiens
  Payload ID: 4237
  Gene Symbol: CCNB1
  Gene Name: cyclin B1
  ENSP ID: ENSP00000423387
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMVSQ

SEQ ID NO: 20965 - protein, 396 aa, Homo sapiens
  Payload ID: 4237
  Gene Symbol: CCNB1
  Gene Name: cyclin B1
  Uniprot ID: P14635
  ENSP ID: ENSP00000424588
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTVKNKYATSKHAKISTLPQLNSALVQDLAKAVAKV

SEQ ID NO: 20966 - protein, 61 aa, Homo sapiens
  Payload ID: 4237
  Gene Symbol: CCNB1
  Gene Name: cyclin B1
  ENSP ID: ENSP00000425103
ALRVTRVSRFGLRTNAAFLAAACSPCLACGSLPSGRGPQERFGEEGGRGLTKRAPRWAQAW

SEQ ID NO: 20967 - protein, 244 aa, Homo sapiens
  Payload ID: 4237
  Gene Symbol: CCNB1
  Gene Name: cyclin B1
  ENSP ID: ENSP00000426092
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLENNCVPKKMLQLVGVTAMFIASKYEEMYPPEIGDFAFVTDNTYTKHQIRQMEMKILRALNFGL

SEQ ID NO: 20968 - protein, 185 aa, Homo sapiens
  Payload ID: 4237
  Gene Symbol: CCNB1
  Gene Name: cyclin B1
  ENSP ID: ENSP00000426230
QAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWLCSTWLRM

SEQ ID NO: 20969 - protein, 277 aa, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000337396
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 20970 - protein, 277 aa, Homo sapiens; identical to SEQ ID NO: 20969
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000351810

SEQ ID NO: 20971 - protein, 277 aa, Homo sapiens; identical to SEQ ID NO: 20969
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000381226

SEQ ID NO: 20972 - protein, 277 aa, Homo sapiens; identical to SEQ ID NO: 20969
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000381229

SEQ ID NO: 20973 - protein, 277 aa, Homo sapiens; identical to SEQ ID NO: 20969
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000381235

SEQ ID NO: 20974 - protein, 277 aa, Homo sapiens; identical to SEQ ID NO: 20969
  Payload ID: 4238
  Gene Symbol: CCNB1IP1
  Gene Name: cyclin B1 interacting protein 1, E3 ubiquitin protein ligase
  Uniprot ID: Q9NPC3
  ENSP ID: ENSP00000409896

SEQ ID NO: 20975 - protein, 64 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000450914
  MOD_RES (1)..(1): Any amino acid
XEFSRSPAICPACNSTLSGKLDIVRTELSPSEEYKAMVLAGLRPEIVLDISSRALAFWTYQYFL

SEQ ID NO: 20976 - protein, 31 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000451122
  MOD_RES (1)..(1): Any amino acid
XTLAPERWPSGHIRLVSNSWVQAILPPQPPE

SEQ ID NO: 20977 - protein, 4 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000452182
MSLC

SEQ ID NO: 20978 - protein, 67 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000452312
MFAFLNVVVTLAWPSQLLLPLFSFWRPHYPIMSLCEDMLLCNYRKCRIKLSGYAWVTACSHIFCDQH

SEQ ID NO: 20979 - protein, 102 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000452463
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQYFL

SEQ ID NO: 20980 - protein, 154 aa, Homo sapiens
  Payload ID: 4238
  Gene Symbol: CCNB1IP1
  Gene Name: cyclin B1 interacting protein 1, E3 ubiquitin protein ligase
  ENSP ID: ENSP00000452486
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYK

SEQ ID NO: 20981 - protein, 398 aa, Homo sapiens
  Payload ID: 4239
  Gene Symbol: CCNB2
  Gene Name: cyclin B2
  Uniprot ID: O95067
  ENSP ID: ENSP00000288207
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 20982 - protein, 270 aa, Homo sapiens
  Payload ID: 4239
  Gene Symbol: CCNB2
  Gene Name: cyclin B2
  ENSP ID: ENSP00000453685
MALLRRPTGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGENLKQQYYTGYTENEVLEVMQHMAKNVVKVNENLTKFIAIKNKYASSKLLKISMIPQLNSKAVKDLASPLIGRS

SEQ ID NO: 20983 - protein, 374 aa, Homo sapiens
  Payload ID: 4239
  Gene Symbol: CCNB2
  Gene Name: cyclin B2
  ENSP ID: ENSP00000480809
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIVSTTVFLSCGKL

SEQ ID NO: 20984 - protein, 1395 aa, Homo sapiens
  Payload ID: 4240
  Gene Symbol: CCNB3
  Gene Name: cyclin B3
  Uniprot ID: Q8WWL7
  ENSP ID: ENSP00000276014
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGKICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRSRLKPLVLQEITSGEKSLIMKPLSIKEKPSTEKESFSQEPSALQKKHTTQEEVSILKEPSSLLKSPTEESPFDEALAFTKKCTIEEAPPTKKPLILKRKHATQGTMSHLKKPLILQTTSGEKSLIKEPLPFKEEKVSLKKKCTTQEMMSICPELLDFQDMIGEDKNSFFMEPMSFRKNPTTEETVLTKTSLSLQEKKITQGKMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 20985 - protein, 291 aa, Homo sapiens
  Payload ID: 4240
  Gene Symbol: CCNB3
  Gene Name: cyclin B3
  Uniprot ID: Q8WWL7
  ENSP ID: ENSP00000338682
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 20986 - protein, 291 aa, Homo sapiens; identical to SEQ ID NO: 20985
  Payload ID: 4240
  Gene Symbol: CCNB3
  Gene Name: cyclin B3
  Uniprot ID: Q8WWL7
  ENSP ID: ENSP00000365206

SEQ ID NO: 20987 - protein, 1395 aa, Homo sapiens; identical to SEQ ID NO: 20984
  Payload ID: 4240
  Gene Symbol: CCNB3
  Gene Name: cyclin B3
  Uniprot ID: Q8WWL7
  ENSP ID: ENSP00000365210

SEQ ID NO: 20988 - protein, 111 aa, Homo sapiens
  Payload ID: 4240
  Gene Symbol: CCNB3
  Gene Name: cyclin B3
  Uniprot ID: Q8WWL7
  ENSP ID: ENSP00000431645
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLK

SEQ ID NO: 20989 - protein, 202 aa, Homo sapiens
  Payload ID: 4241
  Gene Symbol: CCNC
  Gene Name: cyclin C
  ENSP ID: ENSP00000319027
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALVID

SEQ ID NO: 20990 - protein, 282 aa, Homo sapiens
  Payload ID: 4241
  Gene Symbol: CCNC
  Gene Name: cyclin C
  ENSP ID: ENSP00000358222
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 20991 - protein, 143 aa, Homo sapiens
  Payload ID: 4241
  Gene Symbol: CCNC
  Gene Name: cyclin C
  ENSP ID: ENSP00000417072
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVCKCKKYICFKDVILKKAPEYIDFFFFSL

SEQ ID NO: 20992 - protein, 162 aa, Homo sapiens
  Payload ID: 4241
  Gene Symbol: CCNC
  Gene Name: cyclin C
  ENSP ID: ENSP00000427885
MAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDER

SEQ ID NO: 20993 - protein, 192 aa, Homo sapiens
  Payload ID: 4241
  Gene Symbol: CCNC
  Gene Name: cyclin C
  ENSP ID: ENSP00000428472
MAGNFWQSSHYPKRRDHFALLKSLEQSWSFLSGKGNECGRQDNSGKTNEKIMKGHCLSLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLEL

SEQ ID NO: 20994 - protein, 49 aa, Homo sapiens
  Payload ID: 4241
  Gene Symbol: CCNC
  Gene Name: cyclin C
  ENSP ID: ENSP00000428577
MAGNFWQSSHYLQWILDKQDLLKERQKDLKFLSEEEYWKLQIFFTNGIL

SEQ ID NO: 20995 - protein, 283 aa, Homo sapiens
  Payload ID: 4241
  Gene Symbol: CCNC
  Gene Name: cyclin C
  Uniprot ID: P24863
  ENSP ID: ENSP00000428982
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 20996 - protein, 198 aa, Homo sapiens
  Payload ID: 4241
  Gene Symbol: CCNC
  Gene Name: cyclin C
  Uniprot ID: P24863
  ENSP ID: ENSP00000430014
MAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 20997 - protein, 228 aa, Homo sapiens
  Payload ID: 4241
  Gene Symbol: CCNC
  Gene Name: cyclin C
  ENSP ID: ENSP00000430077
LKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNRNSLSDSPLVAGPEAAR

SEQ ID NO: 20998 - protein, 198 aa, Homo sapiens; identical to SEQ ID NO: 20996
  Payload ID: 4241
  Gene Symbol: CCNC
  Gene Name: cyclin C
  Uniprot ID: P24863
  ENSP ID: ENSP00000430119

SEQ ID NO: 20999 - protein, 282 aa, Homo sapiens
  Payload ID: 4241
  Gene Symbol: CCNC
  Gene Name: cyclin C
  ENSP ID: ENSP00000430294
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNRNSLSDSPLVAGPEAAR

SEQ ID NO: 21000 - protein, 282 aa, Homo sapiens; identical to SEQ ID NO: 20999
  Payload ID: 4241
  Gene Symbol: CCNC
  Gene Name: cyclin C
  ENSP ID: ENSP00000430381

SEQ ID NO: 21001 - protein, 114 aa, Homo sapiens
  Payload ID: 4241
  Gene Symbol: CCNC
  Gene Name: cyclin C
  ENSP ID: ENSP00000430718
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATS

SEQ ID NO: 21002 - protein, 202 aa, Homo sapiens; identical to SEQ ID NO: 20989
  Payload ID: 4241
  Gene Symbol: CCNC
  Gene Name: cyclin C
  ENSP ID: ENSP00000487040

SEQ ID NO: 21003 - protein, 760 aa, Homo sapiens
  Payload ID: 4242
  Gene Symbol: DMTF1
  Gene Name: cyclin D binding myb-like transcription factor 1
  Uniprot ID: Q9Y222
  ENSP ID: ENSP00000332171
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 21004 - protein, 760 aa, Homo sapiens; identical to SEQ ID NO: 21003
  Payload ID: 4242
  Gene Symbol: DMTF1
  Gene Name: cyclin D binding myb-like transcription factor 1
  Uniprot ID: Q9Y222
  ENSP ID: ENSP00000378193

SEQ ID NO: 21005 - protein, 136 aa, Homo sapiens
  Payload ID: 4242
  Gene Symbol: DMTF1
  Gene Name: cyclin D binding myb-like transcription factor 1
  ENSP ID: ENSP00000387712
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFT

SEQ ID NO: 21006 - protein, 285 aa, Homo sapiens
  Payload ID: 4242
  Gene Symbol: DMTF1
  Gene Name: cyclin D binding myb-like transcription factor 1
  Uniprot ID: Q9Y222
  ENSP ID: ENSP00000389774
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEKKAIAACFFFTHRQLWTPKKGHTFKLWLSKYCCPQLPNQSNGKKKNEE

SEQ ID NO: 21007 - protein, 96 aa, Homo sapiens
  Payload ID: 4242
  Gene Symbol: DMTF1
  Gene Name: cyclin D binding myb-like transcription factor 1
  ENSP ID: ENSP00000393370
MSTVEEDSDTVTVETVNSVTLTQDTEGNLILHCPQNEADEIDSEDSIEPPHKRLCLSSEDDQSIDDSTPCISVVALPLSENDQSFEVTMTATTEVA

SEQ ID NO: 21008 - protein, 90 aa, Homo sapiens
  Payload ID: 4242
  Gene Symbol: DMTF1
  Gene Name: cyclin D binding myb-like transcription factor 1
  ENSP ID: ENSP00000397490
MSTVEEDSDTVTVETVNSVTLTQDTEGNLILHCPQNEADEIDSEDSIEPPHKRLCLSSEDDQSIDDSTPCISVVALPLSENDQSFEVTMT

SEQ ID NO: 21009 - protein, 85 aa, Homo sapiens
  Payload ID: 4242
  Gene Symbol: DMTF1
  Gene Name: cyclin D binding myb-like transcription factor 1
  ENSP ID: ENSP00000401129
MSTVEEDSDTVTVETVNSVTLTQDTEGNLILHCPQNEADEIDSEDSIEPPHKRLCLSSEDDQSIDDSTPCISVVALPLSENDQSF

SEQ ID NO: 21010 - protein, 690 aa, Homo sapiens
  Payload ID: 4242
  Gene Symbol: DMTF1
  Gene Name: cyclin D binding myb-like transcription factor 1
  ENSP ID: ENSP00000402627
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPASADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 21011 - protein, 10 aa, Homo sapiens
  Payload ID: 4242
  Gene Symbol: DMTF1
  Gene Name: cyclin D binding myb-like transcription factor 1
  ENSP ID: ENSP00000406384
MTATTEVADD

SEQ ID NO: 21012 - protein, 272 aa, Homo sapiens
  Payload ID: 4242
  Gene Symbol: DMTF1
  Gene Name: cyclin D binding myb-like transcription factor 1
  Uniprot ID: Q9Y222
  ENSP ID: ENSP00000407941
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEQLWTPKKGHTFKLWLSKYCCPQLPNQSNGKKKNEE

SEQ ID NO: 21013 - protein, 176 aa, Homo sapiens
  Payload ID: 4242
  Gene Symbol: DMTF1
  Gene Name: cyclin D binding myb-like transcription factor 1
  ENSP ID: ENSP00000410288
  MOD_RES (1)..(1): Any amino acid
XTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEIPYSNIIRKNQISLDHPWAVLFQKIQRMSKIW

SEQ ID NO: 21014 - protein, 49 aa, Homo sapiens
  Payload ID: 4242
  Gene Symbol: DMTF1
  Gene Name: cyclin D binding myb-like transcription factor 1
  ENSP ID: ENSP00000411858
MSTVEEDSDTVTVETVNSVTLTQDTEGNLILHCPQNEADEIDSEDSIEP

SEQ ID NO: 21015 - protein, 244 aa, Homo sapiens
  Payload ID: 4242
  Gene Symbol: DMTF1
  Gene Name: cyclin D binding myb-like transcription factor 1
  Uniprot ID: Q9Y222
  ENSP ID: ENSP00000411908
MSTVEEDSDTVTVETVNSVTLTQDTEGNLILHCPQNVSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKEKKAIAACFFFTHRQLWTPKKGHTFKLWLSKYCCPQLPNQSNGKKKNEE

SEQ ID NO: 21016 - protein, 672 aa, Homo sapiens
  Payload ID: 4242
  Gene Symbol: DMTF1
  Gene Name: cyclin D binding myb-like transcription factor 1
  Uniprot ID: Q9Y222
  ENSP ID: ENSP00000412532
MTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 21017 - protein, 49 aa, Homo sapiens; identical to SEQ ID NO: 21014
  Payload ID: 4242
  Gene Symbol: DMTF1
  Gene Name: cyclin D binding myb-like transcription factor 1
  ENSP ID: ENSP00000412734

SEQ ID NO: 21018 - protein, 27 aa, Homo sapiens
  Payload ID: 4242
  Gene Symbol: DMTF1
  Gene Name: cyclin D binding myb-like transcription factor 1
  ENSP ID: ENSP00000413118
MSTVEEDSDTVTVETVNSVTLTQDTEG

SEQ ID NO: 21019 - protein, 40 aa, Homo sapiens
  Payload ID: 4242
  Gene Symbol: DMTF1
  Gene Name: cyclin D binding myb-like transcription factor 1
  ENSP ID: ENSP00000413722
MSTVEEDSDTVTVETVNSVTLTQDTEGNLILHCPQNEADE

SEQ ID NO: 21020 - protein, 73 aa, Homo sapiens
  Payload ID: 4242
  Gene Symbol: DMTF1
  Gene Name: cyclin D binding myb-like transcription factor 1
  ENSP ID: ENSP00000415382
MSTVEEDSDTVTVETVNSVTLTQDTEGNLILHCPQNEADEIDSEDSIEPPHKRLCLSSEDDQSIDDSTPCISV

SEQ ID NO: 21021 - protein, 175 aa, Homo sapiens
  Payload ID: 4242
  Gene Symbol: DMTF1
  Gene Name: cyclin D binding myb-like transcription factor 1
  ENSP ID: ENSP00000416307
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKAR

SEQ ID NO: 21022 - protein, 191 aa, Homo sapiens
  Payload ID: 4242
  Gene Symbol: DMTF1
  Gene Name: cyclin D binding myb-like transcription factor 1
  ENSP ID: ENSP00000416499
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDE

SEQ ID NO: 21023 - protein, 378 aa, Homo sapiens
  Payload ID: 4242
  Gene Symbol: DMTF1
  Gene Name: cyclin D binding myb-like transcription factor 1
  ENSP ID: ENSP00000448775
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILSGFSAHAKYQIEGVETEVLSISTEQDSRT

SEQ ID NO: 21024 - protein, 34 aa, Homo sapiens
  Payload ID: 4242
  Gene Symbol: DMTF1
  Gene Name: cyclin D binding myb-like transcription factor 1
  ENSP ID: ENSP00000461920
MSTVEEDSDTVTVETVNSVTLTQDTEGNLILHCP

SEQ ID NO: 21025 - protein, 178 aa, Homo sapiens
  Payload ID: 4242
  Gene Symbol: DMTF1
  Gene Name: cyclin D binding myb-like transcription factor 1
  ENSP ID: ENSP00000463239
PEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTGTVI

SEQ ID NO: 21026 - protein, 365 aa, Homo sapiens
  Payload ID: 4242
  Gene Symbol: DMTF1
  Gene Name: cyclin D binding myb-like transcription factor 1
  ENSP ID: ENSP00000463638
MSTVEEDSDTVTVETVNSVTLTQDTEGNLILHCPQNVSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVCSMFR

SEQ ID NO: 21027 - protein, 16 aa, Homo sapiens
  Payload ID: 4242
  Gene Symbol: DMTF1
  Gene Name: cyclin D binding myb-like transcription factor 1
  ENSP ID: ENSP00000463735
MSTVEEDSDTVTVETV

SEQ ID NO: 21028 - protein, 272 aa, Homo sapiens; identical to SEQ ID NO: 21012
  Payload ID: 4242
  Gene Symbol: DMTF1
  Gene Name: cyclin D binding myb-like transcription factor 1
  Uniprot ID: Q9Y222
  ENSP ID: ENSP00000464092

SEQ ID NO: 21029 - protein, 272 aa, Homo sapiens; identical to SEQ ID NO: 21012
  Payload ID: 4242
  Gene Symbol: DMTF1
  Gene Name: cyclin D binding myb-like transcription factor 1
  Uniprot ID: Q9Y222
  ENSP ID: ENSP00000464596

SEQ ID NO: 21030 - protein, 295 aa, Homo sapiens
  Payload ID: 4243
  Gene Symbol: CCND1
  Gene Name: cyclin D1
  Uniprot ID: P24385
  ENSP ID: ENSP00000227507
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 21031 - protein, 67 aa, Homo sapiens
  Payload ID: 4243
  Gene Symbol: CCND1
  Gene Name: cyclin D1
  ENSP ID: ENSP00000438482
MEHQLLCCEVETIRRAYPDANLLNDRVLRAMLKAEETCAPSVSYFKCVQKEVLPSMRKIVATWMLEM

SEQ ID NO: 21032 - protein, 289 aa, Homo sapiens
  Payload ID: 4244
  Gene Symbol: CCND2
  Gene Name: cyclin D2
  Uniprot ID: P30279
  ENSP ID: ENSP00000261254
MELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQQDEEVSSLTCDALTELLAKITNTDVDCLKACQEQIEAVLLNSLQQYRQDQRDGSKSEDELDQASTPTDVRDIDL

SEQ ID NO: 21033 - protein, 170 aa, Homo sapiens
  Payload ID: 4244
  Gene Symbol: CCND2
  Gene Name: cyclin D2
  ENSP ID: ENSP00000442807
  MOD_RES (1)..(1): Any amino acid
XRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATAQQVGQGKGKGCNQEMPQERLRGVSKSQRPAPDSISASFRVARRLLLLRHVCHVQHSSQTHSLD

SEQ ID NO: 21034 - protein, 242 aa, Homo sapiens
  Payload ID: 4245
  Gene Symbol: CCND3
  Gene Name: cyclin D3
  ENSP ID: ENSP00000362078
MKSAGGSGRSLLPSPRVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 21035 - protein, 211 aa, Homo sapiens
  Payload ID: 4245
  Gene Symbol: CCND3
  Gene Name: cyclin D3
  Uniprot ID: P30281
  ENSP ID: ENSP00000362079
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 21036 - protein, 292 aa, Homo sapiens
  Payload ID: 4245
  Gene Symbol: CCND3
  Gene Name: cyclin D3
  Uniprot ID: P30281
  ENSP ID: ENSP00000362082
MELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 21037 - protein, 220 aa, Homo sapiens
  Payload ID: 4245
  Gene Symbol: CCND3
  Gene Name: cyclin D3
  Uniprot ID: P30281
  ENSP ID: ENSP00000397545
MELLCCEGTRHAPRAGPDPRLLGDQRVLQSLLRLEERYVPRASYFQCVQREIKPHMRKMLAYWMLEDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 21038 - protein, 96 aa, Homo sapiens
  Payload ID: 4245
  Gene Symbol: CCND3
  Gene Name: cyclin D3
  Uniprot ID: P30281
  ENSP ID: ENSP00000401595
MYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 21039 - protein, 46 aa, Homo sapiens
  Payload ID: 4245
  Gene Symbol: CCND3
  Gene Name: cyclin D3
  ENSP ID: ENSP00000420991
MKSAGGSGRSLLPSPRVCEEQRCEEEVFPLAMNYLDRYLSCVPTRK

SEQ ID NO: 21040 - protein, 175 aa, Homo sapiens
  Payload ID: 4245
  Gene Symbol: CCND3
  Gene Name: cyclin D3
  ENSP ID: ENSP00000421511
VCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVVSAG

SEQ ID NO: 21041 - protein, 10 aa, Homo sapiens
  Payload ID: 4245
  Gene Symbol: CCND3
  Gene Name: cyclin D3
  ENSP ID: ENSP00000423242
MYPPSMIATG

SEQ ID NO: 21042 - protein, 43 aa, Homo sapiens
  Payload ID: 4245
  Gene Symbol: CCND3
  Gene Name: cyclin D3
  ENSP ID: ENSP00000425334
MNYLDRYLSCVPTRKAQLQLLGAVCMLLASKLRETTPLTIEKL

SEQ ID NO: 21043 - protein, 118 aa, Homo sapiens
  Payload ID: 4245
  Gene Symbol: CCND3
  Gene Name: cyclin D3
  ENSP ID: ENSP00000425830
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYP

SEQ ID NO: 21044 - protein, 195 aa, Homo sapiens
  Payload ID: 4245
  Gene Symbol: CCND3
  Gene Name: cyclin D3
  ENSP ID: ENSP00000425986
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATGLPAGLSGADRSCTQGEPQGSLSDQLQPSAQSPPGLQQPRAQPDQHSYRCHSHTPVALERPSGVATKQRRGRCHPPPCLQEPHHI

SEQ ID NO: 21045 - protein, 211 aa, Homo sapiens; identical to SEQ ID NO: 21035
  Payload ID: 4245
  Gene Symbol: CCND3
  Gene Name: cyclin D3
  Uniprot ID: P30281
  ENSP ID: ENSP00000426212

SEQ ID NO: 21046 - protein, 96 aa, Homo sapiens; identical to SEQ ID NO: 21038
  Payload ID: 4245
  Gene Symbol: CCND3
  Gene Name: cyclin D3
  Uniprot ID: P30281
  ENSP ID: ENSP00000484424

SEQ ID NO: 21047 - protein, 360 aa, Homo sapiens
  Payload ID: 4246
  Gene Symbol: CCNDBP1
  Gene Name: cyclin D-type binding-protein 1
  Uniprot ID: O95273
  ENSP ID: ENSP00000300213
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 21048 - protein, 62 aa, Homo sapiens
  Payload ID: 4246
  Gene Symbol: CCNDBP1
  Gene Name: cyclin D-type binding-protein 1
  ENSP ID: ENSP00000454420
MASATAPAAAVPTLASPLEQLRHLAEELRLLLPRVRVGEAQETTEEFNREMFWRRLRNPEVL

SEQ ID NO: 21049 - protein, 309 aa, Homo sapiens
  Payload ID: 4246
  Gene Symbol: CCNDBP1
  Gene Name: cyclin D-type binding-protein 1
  Uniprot ID: O95273
  ENSP ID: ENSP00000455419
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINEP

SEQ ID NO: 21050 - protein, 62 aa, Homo sapiens; identical to SEQ ID NO: 21048
  Payload ID: 4246
  Gene Symbol: CCNDBP1
  Gene Name: cyclin D-type binding-protein 1
  ENSP ID: ENSP00000455687

SEQ ID NO: 21051 - protein, 142 aa, Homo sapiens
  Payload ID: 4246
  Gene Symbol: CCNDBP1
  Gene Name: cyclin D-type binding-protein 1
  ENSP ID: ENSP00000456041
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQALRTMTLFPTTVSGLRASRCLRYQEITKLQLF

SEQ ID NO: 21052 - protein, 309 aa, Homo sapiens; identical to SEQ ID NO: 21049
  Payload ID: 4246
  Gene Symbol: CCNDBP1
  Gene Name: cyclin D-type binding-protein 1
  Uniprot ID: O95273
  ENSP ID: ENSP00000456797

SEQ ID NO: 21053 - protein, 42 aa, Homo sapiens
  Payload ID: 4246
  Gene Symbol: CCNDBP1
  Gene Name: cyclin D-type binding-protein 1
  ENSP ID: ENSP00000456839
MASATAPAAAVPTLASPLEQLRHLAEELRLLLPRVRGNPEVL

SEQ ID NO: 21054 - protein, 42 aa, Homo sapiens; identical to SEQ ID NO: 21053
  Payload ID: 4246
  Gene Symbol: CCNDBP1
  Gene Name: cyclin D-type binding-protein 1
  ENSP ID: ENSP00000457611

SEQ ID NO: 21055 - protein, 410 aa, Homo sapiens
  Payload ID: 4247
  Gene Symbol: CCNE1
  Gene Name: cyclin E1
  Uniprot ID: P24864
  ENSP ID: ENSP00000262643
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 21056 - protein, 350 aa, Homo sapiens
  Payload ID: 4247
  Gene Symbol: CCNE1
  Gene Name: cyclin E1
  ENSP ID: ENSP00000350625
MKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKLLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 21057 - protein, 395 aa, Homo sapiens
  Payload ID: 4247
  Gene Symbol: CCNE1
  Gene Name: cyclin E1
  Uniprot ID: P24864
  ENSP ID: ENSP00000410179
MKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 21058 - protein, 215 aa, Homo sapiens
  Payload ID: 4247
  Gene Symbol: CCNE1
  Gene Name: cyclin E1
  ENSP ID: ENSP00000459024
MPRERRERDAKERDTMKEDGGAEFSARSRKRKANVTVDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTD

SEQ ID NO: 21059 - protein, 283 aa, Homo sapiens
  Payload ID: 4247
  Gene Symbol: CCNE1
  Gene Name: cyclin E1
  ENSP ID: ENSP00000460881
DDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKLLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 21060 - protein, 404 aa, Homo sapiens
  Payload ID: 4248
  Gene Symbol: CCNE2
  Gene Name: cyclin E2
  Uniprot ID: O96020
  ENSP ID: ENSP00000309181
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 21061 - protein, 374 aa, Homo sapiens
  Payload ID: 4248
  Gene Symbol: CCNE2
  Gene Name: cyclin E2
  ENSP ID: ENSP00000379437
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLCMISSHV

SEQ ID NO: 21062 - protein, 75 aa, Homo sapiens
  Payload ID: 4248
  Gene Symbol: CCNE2
  Gene Name: cyclin E2
  ENSP ID: ENSP00000428988
MSRRSSRLQAKQQPQPSQTESPQEAQIIQAKKRKTTQDVKKRREEVTKKHQYEIRLGMFKRSLAKHVKKGEQICS

SEQ ID NO: 21063 - protein, 404 aa, Homo sapiens; identical to SEQ ID NO: 21060
  Payload ID: 4248
  Gene Symbol: CCNE2
  Gene Name: cyclin E2
  Uniprot ID: O96020
  ENSP ID: ENSP00000429089

SEQ ID NO: 21064 - protein, 152 aa, Homo sapiens
  Payload ID: 4248
  Gene Symbol: CCNE2
  Gene Name: cyclin E2
  ENSP ID: ENSP00000430060
  MOD_RES (1)..(1): Any amino acid
XEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLFSHFSYLLDQ

SEQ ID NO: 21065 - protein, 61 aa, Homo sapiens
  Payload ID: 4248
  Gene Symbol: CCNE2
  Gene Name: cyclin E2
  ENSP ID: ENSP00000430875
MSRRSSRLQAKQQPQPSQTESPQEAQIIQAKKRKTTQFTNGLFYFPGCQKKKRGGHQETSV

SEQ ID NO: 21066 - protein, 296 aa, Homo sapiens
  Payload ID: 4248
  Gene Symbol: CCNE2
  Gene Name: cyclin E2
  ENSP ID: ENSP00000479777
MSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 21067 - protein, 59 aa, Homo sapiens
  Payload ID: 4249
  Gene Symbol: CCNF
  Gene Name: cyclin F
  ENSP ID: ENSP00000293968
MGSGGVVHCRCAKCFCYPTKRRIRRRPRNLTILSLPEDVLFHILKWLSVEDILAVRAGC

SEQ ID NO: 21068 - protein, 786 aa, Homo sapiens
  Payload ID: 4249
  Gene Symbol: CCNF
  Gene Name: cyclin F
  Uniprot ID: P41002
  ENSP ID: ENSP00000380256
MGSGGVVHCRCAKCFCYPTKRRIRRRPRNLTILSLPEDVLFHILKWLSVEDILAVRAVHSQLKDLVDNHASVWACASFQELWPSPGNLKLFERAAEKGNFEAAVKLGIAYLYNEGLSVSDEARAEVNGLKASRFFSLAERLNVGAAPFIWLFIRPPWSVSGSCCKAVVHESLRAECQLQRTHKASILHCLGRVLSLFEDEEKQQQAHDLFEEAAHQGCLTSSYLLWESDRRTDVSDPGRCLHSFRKLRDYAAKGCWEAQLSLAKACANANQLGLEVRASSEIVCQLFQASQAVSKQQVFSVQKGLNDTMRYILIDWLVEVATMKDFTSLCLHLTVECVDRYLRRRLVPRYRLQLLGIACMVICTRFISKEILTIREAVWLTDNTYKYEDLVRMMGEIVSALEGKIRVPTVVDYKEVLLTLVPVELRTQHLCSFLCELSLLHTSLSAYAPARLAAAALLLARLTHGQTQPWTTQLWDLTGFSYEDLIPCVLSLHKKCFHDDAPKDYRQVSLTAVKQRFEDKRYGEISQEEVLSYSQLCAALGVTQDSPDPPTFLSTGEIHAFLSSPSGRRTKRKRENSLQEDRGSFVTTPTAELSSQEETLLGSFLDWSLDCCSGYEGDQESEGEKEGDVTAPSGILDVTVVYLNPEQHCCQESSDEEACPEDKGPQDPQALALDTQIPATPGPKPLVRTSREPGKDVTTSGYSSVSTASPTSSVDGGLGALPQPTSVLSLDSDSHTQPCHHQARKSCLQCRPPSPPESSVPQQQVKRINLCIHSEEEDMNLGLVRL

SEQ ID NO: 21069 - protein, 186 aa, Homo sapiens
  Payload ID: 4249
  Gene Symbol: CCNF
  Gene Name: cyclin F
  ENSP ID: ENSP00000457587
  MOD_RES (1)..(1): Any amino acid
XASSEIVCQLFQASQAVSKQQVFSVQKGLNDTMRYILIDWLVEVATMKDFTSLCLHLTVECVDRYLRRRLVPRYRLQLLGIACMVICTRFISKEILTIREAVWLTDNTYKYEDLVRMMGEIVSALEGKIRPWSRRPRLHHVAICAGALRVQHRREHHPGQTLRWACMRHCTKEPPSAESPHPVPAV

SEQ ID NO: 21070 - protein, 1311 aa, Homo sapiens
  Payload ID: 4250
  Gene Symbol: GAK
  Gene Name: cyclin G associated kinase
  Uniprot ID: O14976
  ENSP ID: ENSP00000314499
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 21071 - protein, 467 aa, Homo sapiens
  Payload ID: 4250
  Gene Symbol: GAK
  Gene Name: cyclin G associated kinase
  ENSP ID: ENSP00000421049
  MOD_RES (1)..(1): Any amino acid
XVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQDPQAQSTVSPRGQRVCTCSRRLPTGKLKPGVADTGTAASPHRHCGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 21072 - protein, 1232 aa, Homo sapiens
  Payload ID: 4250
  Gene Symbol: GAK
  Gene Name: cyclin G associated kinase
  Uniprot ID: O14976
  ENSP ID: ENSP00000421361
MSLLQSALDFLAGPGSLGGASGRDQSDFVGQTVELGELRLRVRRVLAEGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 21073 - protein, 75 aa, Homo sapiens
  Payload ID: 4250
  Gene Symbol: GAK
  Gene Name: cyclin G associated kinase
  ENSP ID: ENSP00000421814
MSLLQSALDFLAGPGSLGGASGRDQSDFVGQTVELGELRLRVRRVLAEGGFAFVYEAQDVGSGREYALKGSWWNF

SEQ ID NO: 21074 - protein, 70 aa, Homo sapiens
  Payload ID: 4250
  Gene Symbol: GAK
  Gene Name: cyclin G associated kinase
  ENSP ID: ENSP00000422391
MKKLSGHPNIVQFCSAASIGKEESDTGQAEFLLLTELCKGQLVEFLKKMESRGPLSCDTVLKIFYQTCRA

SEQ ID NO: 21075 - protein, 69 aa, Homo sapiens
  Payload ID: 4250
  Gene Symbol: GAK
  Gene Name: cyclin G associated kinase
  ENSP ID: ENSP00000424553
PKGSSSWQTSRPPAQGASWPPQAKPPPKACTQPRPNYASNFSVIGAREERGVRAPSFGLTRKGQRPLQR

SEQ ID NO: 21076 - protein, 138 aa, Homo sapiens
  Payload ID: 4250
  Gene Symbol: GAK
  Gene Name: cyclin G associated kinase
  ENSP ID: ENSP00000424701
MSLLQSALDFLAGPGSLGGASGRDQSDFVGQTVELGELRLRVRRVLAEGGFAFVYEAQDVGSGREYALKVENLLLSNQGTIKLCDFGSATTISHYPDYSWSAQRRALVEEEITRNTTPMYRTPEIIDLYSNFPIGEKQ

SEQ ID NO: 21077 - protein, 255 aa, Homo sapiens
  Payload ID: 4250
  Gene Symbol: GAK
  Gene Name: cyclin G associated kinase
  ENSP ID: ENSP00000426062
  MOD_RES (1)..(1): Any amino acid
XLPEPVPQEDGVDLLGLHSEVGAGPAVPPQACKAPSSNTDLLSCLLGPPEAASQGPPEDLLSEDPLLLASPAPPLSVQSTPRGGPPAAGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQA

SEQ ID NO: 21078 - protein, 49 aa, Homo sapiens
  Payload ID: 4250
  Gene Symbol: GAK
  Gene Name: cyclin G associated kinase
  ENSP ID: ENSP00000426728
MSLLQSALDFLAGPGSLGGASGRDQSDFVGQTVELGELRLRVRRVLAEG

SEQ ID NO: 21079 - protein, 118 aa, Homo sapiens
  Payload ID: 4250
  Gene Symbol: GAK
  Gene Name: cyclin G associated kinase
  ENSP ID: ENSP00000426908
MSLLQSALDFLAGPGSLGGASGRDQSDFVGQTVELGELRLRVRRVLAEGGFAFVYEAQDVGSGREYALKRLLSNEEEKNRAIIQEVCFMLCSLGEPAGCLSVGSGGHSHAAASLRTAP

SEQ ID NO: 21080 - protein, 416 aa, Homo sapiens
  Payload ID: 4250
  Gene Symbol: GAK
  Gene Name: cyclin G associated kinase
  ENSP ID: ENSP00000484475
MSLLQSALDFLAGPGSLGGASGRDQSDFVGQTVELGELRLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 21081 - protein, 118 aa, Homo sapiens; identical to SEQ ID NO: 21079
  Payload ID: 4250
  Gene Symbol: GAK
  Gene Name: cyclin G associated kinase
  ENSP ID: ENSP00000486984

SEQ ID NO: 21082 - protein, 295 aa, Homo sapiens
  Payload ID: 4251
  Gene Symbol: CCNG1
  Gene Name: cyclin G1
  Uniprot ID: P51959
  ENSP ID: ENSP00000344635
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 21083 - protein, 295 aa, Homo sapiens; identical to SEQ ID NO: 21082
  Payload ID: 4251
  Gene Symbol: CCNG1
  Gene Name: cyclin G1
  Uniprot ID: P51959
  ENSP ID: ENSP00000377506

SEQ ID NO: 21084 - protein, 114 aa, Homo sapiens
  Payload ID: 4251
  Gene Symbol: CCNG1
  Gene Name: cyclin G1
  ENSP ID: ENSP00000421132
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERN

SEQ ID NO: 21085 - protein, 167 aa, Homo sapiens
  Payload ID: 4251
  Gene Symbol: CCNG1
  Gene Name: cyclin G1
  ENSP ID: ENSP00000422379
MSAKDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 21086 - protein, 136 aa, Homo sapiens
  Payload ID: 4251
  Gene Symbol: CCNG1
  Gene Name: cyclin G1
  ENSP ID: ENSP00000423791
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMR

SEQ ID NO: 21087 - protein, 161 aa, Homo sapiens
  Payload ID: 4251
  Gene Symbol: CCNG1
  Gene Name: cyclin G1
  Uniprot ID: P51959
  ENSP ID: ENSP00000424315
MRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 21088 - protein, 107 aa, Homo sapiens
  Payload ID: 4251
  Gene Symbol: CCNG1
  Gene Name: cyclin G1
  ENSP ID: ENSP00000427086
MRMEKIVLEKVCWKVKATTAFQFLQLYYSLLQENLPLERRNSINFERLEAQLKACHCRIIFSKAKPSVLALSIIALEIQAQKCVELTEGIECLQKHSKDYYSTKKLL

SEQ ID NO: 21089 - protein, 344 aa, Homo sapiens
  Payload ID: 4252
  Gene Symbol: CCNG2
  Gene Name: cyclin G2
  Uniprot ID: Q16589
  ENSP ID: ENSP00000315743
MKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESESEDSCEDMSCGEESLSSSPPSDQECTFFFNFKVAQTLCFPS

SEQ ID NO: 21090 - protein, 344 aa, Homo sapiens
  Payload ID: 4252
  Gene Symbol: CCNG2
  Gene Name: cyclin G2
  ENSP ID: ENSP00000346379
MKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESESSVAQAGVQWPDLSSFQPPPTRFKRFSCLSLRSSWDYRCWS

SEQ ID NO: 21091 - protein, 344 aa, Homo sapiens; identical to SEQ ID NO: 21089
  Payload ID: 4252
  Gene Symbol: CCNG2
  Gene Name: cyclin G2
  Uniprot ID: Q16589
  ENSP ID: ENSP00000379002

SEQ ID NO: 21092 - protein, 344 aa, Homo sapiens; identical to SEQ ID NO: 21089
  Payload ID: 4252
  Gene Symbol: CCNG2
  Gene Name: cyclin G2
  Uniprot ID: Q16589
  ENSP ID: ENSP00000424665

SEQ ID NO: 21093 - protein, 160 aa, Homo sapiens
  Payload ID: 4252
  Gene Symbol: CCNG2
  Gene Name: cyclin G2
  ENSP ID: ENSP00000426085
MKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALN

SEQ ID NO: 21094 - protein, 304 aa, Homo sapiens
  Payload ID: 4252
  Gene Symbol: CCNG2
  Gene Name: cyclin G2
  Uniprot ID: Q16589
  ENSP ID: ENSP00000426476
MKDLGAEHLAGHEGVQLLGLLNVYLEQEERFQPREKGLSLIEATPENDNTLCPGLRNAKVEDLRSLANFFGSCTETFVLAVNILDRFLALMKVKPKHLSCIGVCSFLLAARIVEEDCNIPSTHDVIRISQCKCTASDIKRMEKIISEKLHYELEATTALNFLHLYHTIILCHTSERKEILSLDKLEAQLKACNCRLIFSKAKPSVLALCLLNLEVETLKSVELLEILLLVKKHSKINDTEFFYWRELVSKCLAEYSSPECCKPDLKKLVWIVSRRTAQNLHNSYYSVPELPTIPEGGCFDESER

SEQ ID NO: 21095 - protein, 323 aa, Homo sapiens
  Payload ID: 4253
  Gene Symbol: CCNH
  Gene Name: cyclin H
  Uniprot ID: P51946
  ENSP ID: ENSP00000256897
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 21096 - protein, 249 aa, Homo sapiens
  Payload ID: 4253
  Gene Symbol: CCNH
  Gene Name: cyclin H
  ENSP ID: ENSP00000426075
MPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 21097 - protein, 255 aa, Homo sapiens
  Payload ID: 4253
  Gene Symbol: CCNH
  Gene Name: cyclin H
  ENSP ID: ENSP00000426454
MPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEVCFTPKMNSKLFLLYILV

SEQ ID NO: 21098 - protein, 377 aa, Homo sapiens
  Payload ID: 4254
  Gene Symbol: CCNI
  Gene Name: cyclin I
  Uniprot ID: Q14094
  ENSP ID: ENSP00000237654
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 21099 - protein, 49 aa, Homo sapiens
  Payload ID: 4254
  Gene Symbol: CCNI
  Gene Name: cyclin I
  ENSP ID: ENSP00000421594
MTPRHHCEAYSSAGEEEEEEEEEKNVSPSQRDEVIQWLAKLKYQFNLYP

SEQ ID NO: 21100 - protein, 56 aa, Homo sapiens
  Payload ID: 4254
  Gene Symbol: CCNI
  Gene Name: cyclin I
  ENSP ID: ENSP00000425360
MKFPGPLENQRLSFLLEKAITREAQMWKVNVRKMPSNQNSSTKGIGKRQFLWMFLI

SEQ ID NO: 21101 - protein, 177 aa, Homo sapiens
  Payload ID: 4254
  Gene Symbol: CCNI
  Gene Name: cyclin I
  ENSP ID: ENSP00000425935
  MOD_RES (1)..(1): Any amino acid
XSEILRMERIILDKLNWDLHTATPLDFLHIMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 21102 - protein, 80 aa, Homo sapiens
  Payload ID: 4254
  Gene Symbol: CCNI
  Gene Name: cyclin I
  ENSP ID: ENSP00000426235
MKFPGPLENQRLSFLLEKAITREAQMWKVNVRKMPSNQNVSPSQRDEVIQWLAKLKYQFNLYPETFALASSLLDRFLATV

SEQ ID NO: 21103 - protein, 125 aa, Homo sapiens
  Payload ID: 4254
  Gene Symbol: CCNI
  Gene Name: cyclin I
  ENSP ID: ENSP00000426467
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSS

SEQ ID NO: 21104 - protein, 369 aa, Homo sapiens
  Payload ID: 4255
  Gene Symbol: CCNI2
  Gene Name: cyclin I family, member 2
  Uniprot ID: Q6ZMN8
  ENSP ID: ENSP00000368005
MASGAQLPPQPSSSEVSAVQSPGGRPGAGLEETALGVPLPPSPGEAPLPRSNRSRCPGTRQPGAASLHAASAAVPVRPRRGTAPAGKTADAVPAAAPEQAPRPAPQSRKPRNLEGDLDERRLLCHLQLAQDREARLWRGGKPQDEICDAFEEVVLWLLRLQNTFYFSQSTFNLALTIFGRLLISVKVKEKYLHCATITSLRLAAKVNEEEEFIPQVKDFTKHYGSDYSPNELLRMELAILDRLHWDLYIGTPLDFLTIFHALVVLSWPHVLELLPQRNPSLHVASLTRQLQHCMAGHQLLQFKGSTLALVIITLELERLMPGWCAPISDLLKKAQVGDMQYSCCKELVMQQLRSLQSSSCTDNFVSPAN

SEQ ID NO: 21105 - protein, 385 aa, Homo sapiens
  Payload ID: 4255
  Gene Symbol: CCNI2
  Gene Name: cyclin I family, member 2
  Uniprot ID: Q6ZMN8
  ENSP ID: ENSP00000478257
MASGAQLPPQPSSSEVSAVQSPGGRPGAGLEETALGVPLPPSPGEAPLPRSNRSRCPGTRQPGAASLHAASAAVPVRPRRGTAPAGKTADAVPAAAPEQAPRPAPQSRKPRNLEGDLDERRLLCHLQLAQDREARLWRGGKPQDEICDAFEEVVLWLLRLQNTFYFSQSTFNLALTIFGRLLISVKVKEKYLHCATITSLRLAAKVNEEEEFIPQVKDFTKHYGSDYSPNELLRMELAILDRLHWDLYIGTPLDFLTIEKYGVFCSNIKNHGLQFHALVVLSWPHVLELLPQRNPSLHVASLTRQLQHCMAGHQLLQFKGSTLALVIITLELERLMPGWCAPISDLLKKAQVGDMQYSCCKELVMQQLRSLQSSSCTDNFVSPAN

SEQ ID NO: 21106 - protein, 372 aa, Homo sapiens
  Payload ID: 4256
  Gene Symbol: CCNJ
  Gene Name: cyclin J
  Uniprot ID: Q5T5M9
  ENSP ID: ENSP00000265992
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 21107 - protein, 371 aa, Homo sapiens
  Payload ID: 4256
  Gene Symbol: CCNJ
  Gene Name: cyclin J
  Uniprot ID: Q5T5M9
  ENSP ID: ENSP00000384498
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 21108 - protein, 383 aa, Homo sapiens
  Payload ID: 4256
  Gene Symbol: CCNJ
  Gene Name: cyclin J
  Uniprot ID: Q5T5M9
  ENSP ID: ENSP00000435373
MELEGQWWRGQLAADIHQALRYKELKLPSYKGQSPQLSLRRYFADLIAIVSNRFTLCPSARHLAVYLLDLFMDRYDISIQQLHLVALSCLLLASKFEEKEDSVPKLEQLNSLGCMTNMNLVLTKQNLLHMELLLLETFQWNLCLPTAAHFIEYYLSEAVHETDLHDGWPMICLEKTKLYMAKYADYFLEVSLQDYAFLNYAPSLVAAACVASSRIILRLSPTWPTRLHRLTAYSWDFLVQCIERLLIAHDNDVKEANKQRGQAGPQSAQLSVFQTASQPSRPVHFQQPQYLHQTHQTSLQYRHPTSEQPSCQQIVSTTHTSSYTLQTCPAGFQTSVQGLGHMQTGVGMSLAIPVEVKPCLSVSYNRSYQINEHYPCITPCFER

SEQ ID NO: 21109 - protein, 387 aa, Homo sapiens
  Payload ID: 4257
  Gene Symbol: CCNJL
  Gene Name: cyclin J-like
  ENSP ID: ENSP00000257536
MMDEPWWEGRVASDVHCTLREKELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVVYDNVLKDAVAVKSQALAMVPGTPPTPTQVLFQPPAYPALGQPATTLAQFQTPVQDLCLAYRDSLQAHRSGSLLSGSTGSSLHTPYQPLQPLDMCPVPVPASLSMHMAIAAEPRHCLATTYGSSYFSGSHMFPTGCFDR

SEQ ID NO: 21110 - protein, 435 aa, Homo sapiens
  Payload ID: 4257
  Gene Symbol: CCNJL
  Gene Name: cyclin J-like
  Uniprot ID: Q8IV13
  ENSP ID: ENSP00000377547
MMDEPWWEGRVASDVHCTLREKELKLPTFRAHSPLLKSRRFFVDILTLLSSHCQLCPAARHLAVYLLDHFMDRYNVTTSKQLYTVAVSCLLLANGVSLLSPRLKCSGMISAHCNLHLPGSSNSPASAPHPPPTPPQVAETTGKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVVYDNVLKDAVAVKSQALAMVPGTPPTPTQVLFQPPAYPALGQPATTLAQFQTPVQDLCLAYRDSLQAHRSGSLLSGSTGSSLHTPYQPLQPLDMCPVPVPASLSMHMAIAAEPRHCLATTYGSSYFSGSHMFPTGCFDR

SEQ ID NO: 21111 - protein, 252 aa, Homo sapiens
  Payload ID: 4257
  Gene Symbol: CCNJL
  Gene Name: cyclin J-like
  ENSP ID: ENSP00000427960
MMDEPWWEGRVASDVHCTLREKELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVPLFR

SEQ ID NO: 21112 - protein, 189 aa, Homo sapiens
  Payload ID: 4257
  Gene Symbol: CCNJL
  Gene Name: cyclin J-like
  ENSP ID: ENSP00000428836
MGDSPGGAAILGLAGKLRRVWRESLPPIQALRSHFLGQPRLSGGSPDRHPSAPPVLQELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYY

SEQ ID NO: 21113 - protein, 416 aa, Homo sapiens
  Payload ID: 4257
  Gene Symbol: CCNJL
  Gene Name: cyclin J-like
  ENSP ID: ENSP00000446367
REKELKLPTFRAHSPLLKSRRFFVDILTLLSSHCQLCPAARHLAVYLLDHFMDRYNVTTSKQLYTVAVSCLLLANGVSLLSPRLKCSGMISAHCNLHLPGSSNSPASAPHPPPTPPQVAETTGKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVVYDNVLKDAVAVKSQALAMVPGTPPTPTQVLFQPPAYPALGQPATTLAQFQTPVQDLCLAYRDSLQAHRSGSLLSGSTGSSLHTPYQPLQPLDMCPVPVPASLSMHMAIAAEPRHCLATTYGSSYFSGSHMFPTGCFDR

SEQ ID NO: 21114 - protein, 580 aa, Homo sapiens
  Payload ID: 4258
  Gene Symbol: CCNK
  Gene Name: cyclin K
  Uniprot ID: O75909
  ENSP ID: ENSP00000374529
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPPPPKIPKIETTHPPLPPAHPPPDRKPPLAAALGEAEPPGPVDATDLPKVQIPPPAHPAPVHQPPPLPHRPPPPPPSSYMTGMSTTSSYMSGEGYQSLQSMMKTEGPSYGALPPAYGPPAHLPYHPHVYPPNPPPPPVPPPPASFPPPAIPPPTPGYPPPPPTYNPNFPPPPPRLPPTHAVPPHPPPGLGLPPASYPPPAVPPGGQPPVPPPIPPPGMPPVGGLGRAAWMR

SEQ ID NO: 21115 - protein, 109 aa, Homo sapiens
  Payload ID: 4258
  Gene Symbol: CCNK
  Gene Name: cyclin K
  ENSP ID: ENSP00000450440
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEET

SEQ ID NO: 21116 - protein, 227 aa, Homo sapiens
  Payload ID: 4258
  Gene Symbol: CCNK
  Gene Name: cyclin K
  ENSP ID: ENSP00000450792
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTS

SEQ ID NO: 21117 - protein, 378 aa, Homo sapiens
  Payload ID: 4258
  Gene Symbol: CCNK
  Gene Name: cyclin K
  ENSP ID: ENSP00000452307
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPQQPAQQQQPAQQPKKPSPQPSSPRQVKRAVVVSPKEENKAAEPPPPKIPKIETTHPPLPPAHPPPASTHPP

SEQ ID NO: 21118 - protein, 172 aa, Homo sapiens
  Payload ID: 4259
  Gene Symbol: CCNL1
  Gene Name: cyclin L1
  Uniprot ID: Q9UK58
  ENSP ID: ENSP00000295925
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSDQLHLPKPG

SEQ ID NO: 21119 - protein, 526 aa, Homo sapiens
  Payload ID: 4259
  Gene Symbol: CCNL1
  Gene Name: cyclin L1
  Uniprot ID: Q9UK58
  ENSP ID: ENSP00000295926
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 21120 - protein, 59 aa, Homo sapiens
  Payload ID: 4259
  Gene Symbol: CCNL1
  Gene Name: cyclin L1
  ENSP ID: ENSP00000417218
  MOD_RES (1)..(1): Any amino acid
XRKKPNYELLEKEVEKRKVALQEAKLKAKGLNPDGTPALSTLGGFSPASKPCKMYLELK

SEQ ID NO: 21121 - protein, 232 aa, Homo sapiens
  Payload ID: 4259
  Gene Symbol: CCNL1
  Gene Name: cyclin L1
  Uniprot ID: Q9UK58
  ENSP ID: ENSP00000417237
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWVVHDGKS

SEQ ID NO: 21122 - protein, 172 aa, Homo sapiens; identical to SEQ ID NO: 21118
  Payload ID: 4259
  Gene Symbol: CCNL1
  Gene Name: cyclin L1
  Uniprot ID: Q9UK58
  ENSP ID: ENSP00000417343

SEQ ID NO: 21123 - protein, 172 aa, Homo sapiens; identical to SEQ ID NO: 21118
  Payload ID: 4259
  Gene Symbol: CCNL1
  Gene Name: cyclin L1
  Uniprot ID: Q9UK58
  ENSP ID: ENSP00000418094

SEQ ID NO: 21124 - protein, 172 aa, Homo sapiens; identical to SEQ ID NO: 21118
  Payload ID: 4259
  Gene Symbol: CCNL1
  Gene Name: cyclin L1
  Uniprot ID: Q9UK58
  ENSP ID: ENSP00000418449

SEQ ID NO: 21125 - protein, 428 aa, Homo sapiens
  Payload ID: 4259
  Gene Symbol: CCNL1
  Gene Name: cyclin L1
  ENSP ID: ENSP00000420277
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRQDEVLLRCPGRSRTPGLK

SEQ ID NO: 21126 - protein, 172 aa, Homo sapiens; identical to SEQ ID NO: 21118
  Payload ID: 4259
  Gene Symbol: CCNL1
  Gene Name: cyclin L1
  Uniprot ID: Q9UK58
  ENSP ID: ENSP00000487951

SEQ ID NO: 21127 - protein, 520 aa, Homo sapiens
  Payload ID: 4260
  Gene Symbol: CCNL2
  Gene Name: cyclin L2
  Uniprot ID: Q96S94
  ENSP ID: ENSP00000383611
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 21128 - protein, 347 aa, Homo sapiens [sequence omitted]

SEQ ID NO: 21129 - protein, 226 aa, Homo sapiens
  Payload ID: 4260
  Gene Symbol: CCNL2
  Gene Name: cyclin L2
  Uniprot ID: Q96S94
  ENSP ID: ENSP00000386158
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEGK

SEQ ID NO: 21130 - protein, 180 aa, Homo sapiens
  Payload ID: 4260
  Gene Symbol: CCNL2
  Gene Name: cyclin L2
  ENSP ID: ENSP00000392899
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVRARPRASGPGGHGYRAGVVPAVLLYQVLREALHGACVNGLCPPGFQDRRGPKTHTGRHQCVSPPSTAERQKEARASTTGSRLC

SEQ ID NO: 21131 - protein, 236 aa, Homo sapiens
  Payload ID: 4260
  Gene Symbol: CCNL2
  Gene Name: cyclin L2
  ENSP ID: ENSP00000423734
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEDPLLKWDSWQRL

SEQ ID NO: 21132 - protein, 227 aa, Homo sapiens
  Payload ID: 4260
  Gene Symbol: CCNL2
  Gene Name: cyclin L2
  ENSP ID: ENSP00000424647
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWVASEGIT

SEQ ID NO: 21133 - protein, 46 aa, Homo sapiens
  Payload ID: 4260
  Gene Symbol: CCNL2
  Gene Name: cyclin L2
  ENSP ID: ENSP00000462056
  MOD_RES (1)..(1): Any amino acid
XEEAPRRIRDVINVFHRLRQLRDKKPCALSLAGSPCLYYWIKIMLI

SEQ ID NO: 21134 - protein, 85 aa, Homo sapiens
  Payload ID: 4260
  Gene Symbol: CCNL2
  Gene Name: cyclin L2
  ENSP ID: ENSP00000464685
MATGQVLFQRFFYTKSFVKHSMEHVSMACVHLASKIEEAPRRIRDVINVFHRLRQLRDKKKPVPLLLDQDYVNLKNQIIKAERRV

SEQ ID NO: 21135 - protein, 330 aa, Homo sapiens
  Payload ID: 4261
  Gene Symbol: CNTD1
  Gene Name: cyclin N-terminal domain containing 1
  Uniprot ID: Q8N815
  ENSP ID: ENSP00000465204
MDGPMRPRSASLVDFQFGVVATETIEDALLHLAQQNEQAVREASGRLGRFREPQIVEFVFLLSEQWCLEKSVSYQAVEILERFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 21136 - protein, 176 aa, Homo sapiens
  Payload ID: 4261
  Gene Symbol: CNTD1
  Gene Name: cyclin N-terminal domain containing 1
  ENSP ID: ENSP00000465999
MDAGEFVFLLSEQWCLEKSVSYQAVEILERFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLL

SEQ ID NO: 21137 - protein, 113 aa, Homo sapiens
  Payload ID: 4261
  Gene Symbol: CNTD1
  Gene Name: cyclin N-terminal domain containing 1
  ENSP ID: ENSP00000467787
TLLEVLGYNGCLVPAMRLHATCLTLLDLVYLLHEPIYESLLRASIENSTPSQLQGEKFTSVKEDFMLLAVGIIAASAFIQNHECWSQVCTTEQDQHGCGAFAEHHWYCLGKHC

SEQ ID NO: 21138 - protein, 59 aa, Homo sapiens
  Payload ID: 4261
  Gene Symbol: CNTD1
  Gene Name: cyclin N-terminal domain containing 1
  ENSP ID: ENSP00000468459
MDGPMRPRSASLVDFQFGVVATETIEDALLHLAQQNEQAVREASGRLGRFREPQIVGLW

SEQ ID NO: 21139 - protein, 247 aa, Homo sapiens
  Payload ID: 4261
  Gene Symbol: CNTD1
  Gene Name: cyclin N-terminal domain containing 1
  ENSP ID: ENSP00000468725
MVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 21140 - protein, 155 aa, Homo sapiens
  Payload ID: 4262
  Gene Symbol: CNTD2
  Gene Name: cyclin N-terminal domain containing 2
  Uniprot ID: Q9H8S5
  ENSP ID: ENSP00000221818
MLVRGRDQGSGSRLGPIVRRWAPRPSPLQSLAASLDAEPSSAAVPDGFPAGPTVSPRRLARPPGLEEALSALGLQGEREYAGDIFAEVMEYLGLAGDTLYLAVHLLDSYLSAGRVRLHRLQLLGVACLFVACKMEECVLPEETEVRNLGPFQGRE

SEQ ID NO: 21141 - protein, 307 aa, Homo sapiens
  Payload ID: 4262
  Gene Symbol: CNTD2
  Gene Name: cyclin N-terminal domain containing 2
  Uniprot ID: Q9H8S5
  ENSP ID: ENSP00000396755
MLVRGRDQGSGSRLGPIVRRWAPRPSPLQSLAASLDAEPSSAAVPDGFPAGPTVSPRRLARPPGLEEALSALGLQGEREYAGDIFAEVMVCRVLPLRALPRAVTPEMRALVVDWLVQVHEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 21142 - protein, 201 aa, Homo sapiens
  Payload ID: 4262
  Gene Symbol: CNTD2
  Gene Name: cyclin N-terminal domain containing 2
  ENSP ID: ENSP00000425529
MRALVVDWLVQVHEYLGLAGDTLYLAVHLLDSYLSAGRVRLHRLQLLGVACLFVACKMEECVLPEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYRCSLGGGSVWGHRSFRDLPSWSFLRSRRMRDNY

SEQ ID NO: 21143 - protein, 160 aa, Homo sapiens
  Payload ID: 4262
  Gene Symbol: CNTD2
  Gene Name: cyclin N-terminal domain containing 2
  ENSP ID: ENSP00000470643
PEPAFLCLLSADSFSRAELLRAERRILSRLDFRLHHPGPLLCLGLLAALAGSSPQVMLLATYFLELSLLEAEAAGWEPGRRAAAALSLAHRLLDGAGSRLQPELYSPEELGTLEPCMARAALRGPAPGRAAVFLKYARPQRQGTSLAAACLLRRLQSEPP

SEQ ID NO: 21144 - protein, 350 aa, Homo sapiens
  Payload ID: 4263
  Gene Symbol: CCNO
  Gene Name: cyclin O
  Uniprot ID: P22674
  ENSP ID: ENSP00000282572
MVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVTAESRCKLLSWLIPVHRQFGLSFESLCLTVNTLDRFLTTTPVAADCFQLLGVTSLLIACKQVEVHPPRVKQLLALCCGAFSRQQLCNLECIVLHKLHFTLGAPTISFFLEHFTHARVEAGQAEASEALEAQALARGVAELSLADYAFTSYSPSLLAICCLALADRMLRVSRPVDLRLGDHPEAALEDCMGKLQLLVAINSTSLTHMLPVQICEKCSLPPSSK

SEQ ID NO: 21145 - protein, 131 aa, Homo sapiens
  Payload ID: 4263
  Gene Symbol: CCNO
  Gene Name: cyclin O
  Uniprot ID: P22674
  ENSP ID: ENSP00000422485
MVTPCPTSPSSPAARAGRRDNDQNLRAPVKKSRRPRLRRKQPLHPLNPCPLPGDSGICDLFESPSSGSDGAESPSAARGGSPLPGPAQPVAQLDLQTFRDYGQSCYAFRKAQESHFHPREALARQPQVRCW

SEQ ID NO: 21146 - protein, 410 aa, Homo sapiens
  Payload ID: 4264
  Gene Symbol: CNPPD1
  Gene Name: cyclin Pas1/PHO80 domain containing 1
  Uniprot ID: Q9BV87
  ENSP ID: ENSP00000353698
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSLANVSSCLEGSMGLRSLWGSLLASLTPPPLPPPDPPAPPTLLHNCHLCQKLQRDSPTCHACLHPNRTVPTALSSPWYHTYGLAPPWPWSPVLLSLPQPQQCSLFSVMELARLKSFVFPG

SEQ ID NO: 21147 - protein, 410 aa, Homo sapiens; identical to SEQ ID NO: 21146
  Payload ID: 4264
  Gene Symbol: CNPPD1
  Gene Name: cyclin Pas1/PHO80 domain containing 1
  Uniprot ID: Q9BV87
  ENSP ID: ENSP00000386277

SEQ ID NO: 21148 - protein, 283 aa, Homo sapiens
  Payload ID: 4264
  Gene Symbol: CNPPD1
  Gene Name: cyclin Pas1/PHO80 domain containing 1
  ENSP ID: ENSP00000405997
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMVRHPLPISLKSQEPAMSSAPPLLVPLQMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQS

SEQ ID NO: 21149 - protein, 308 aa, Homo sapiens
  Payload ID: 4264
  Gene Symbol: CNPPD1
  Gene Name: cyclin Pas1/PHO80 domain containing 1
  ENSP ID: ENSP00000410109
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSLANVSSCLEGSMGLRSL

SEQ ID NO: 21150 - protein, 726 aa, Homo sapiens
  Payload ID: 4265
  Gene Symbol: CCNT1
  Gene Name: cyclin T1
  Uniprot ID: O60563
  ENSP ID: ENSP00000261900
MEGERKNNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIWNWRACEAAKKTKADDRGTDEKTSEQTILNMISQSSSDTTIAGLMSMSTSTTSAVPSLPVSEESSSNLTSVEMLPGKRWLSSQPSFKLEPTQGHRTSENLALTGVDHSLPQDGSNAFISQKQNSKSVPSAKVSLKEYRAKHAEELAAQKRQLENMEANVKSQYAYAAQNLLSHHDSHSSVILKMPIEGSENPERPFLEKADKTALKMRIPVAGGDKAASSKPEEIKMRIKVHAAADKHNSVEDSVTKSREHKEKHKTHPSNHHHHHNHHSHKHSHSQLPVGTGNKRPGDPKHSSQTSNLAHKTYSLSSSFSSSSSTRKRGPSEETGGAVFDHPAKIAKSTKSSSLNFSFPSLPTMGQMPGHSSDTSGLSFSQPSCKTRVPHSKLDKGPTGANGHNTTQTIDYQDTVNMLHSLLSAQGVQPTQPTAFEFVRPYSDYLNPRSGGISSRSGNTDKPRPPPLPSEPPPPLPPLPK

SEQ ID NO: 21151 - protein, 184 aa, Homo sapiens
  Payload ID: 4265
  Gene Symbol: CCNT1
  Gene Name: cyclin T1
  Uniprot ID: O60563
  ENSP ID: ENSP00000399845
MEGERKNNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNRTDT

SEQ ID NO: 21152 - protein, 184 aa, Homo sapiens; identical to SEQ ID NO: 21151
  Payload ID: 4265
  Gene Symbol: CCNT1
  Gene Name: cyclin T1
  Uniprot ID: O60563
  ENSP ID: ENSP00000481035

SEQ ID NO: 21153 - protein, 730 aa, Homo sapiens
  Payload ID: 4266
  Gene Symbol: CCNT2
  Gene Name: cyclin T2
  Uniprot ID: O60583
  ENSP ID: ENSP00000264157
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGSSSSSSSSVKQYISSHNSVFNHPLPPPPPVTYQVGYGHLSTLVKLDKKPVETNGPDANHEYSTSSQHMDYKDTFDMLDSLLSAQGMNM

SEQ ID NO: 21154 - protein, 663 aa, Homo sapiens
  Payload ID: 4266
  Gene Symbol: CCNT2
  Gene Name: cyclin T2
  Uniprot ID: O60583
  ENSP ID: ENSP00000295238
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVDSVTGVPTNPSFQKPSTSAFPAPVPLNSGNISVQDSHTSDNLSMLATGMPSTSYGLSSHQEWPQHQDSARTEQLYSQKQETSLSGSQYNINFQQGPSISLHSGLHHRPDKISDHSSVKQEYTHKAGSSKHHGPISTTPGIIPQKMSLDKYREKRKLETLDLDVRDHYIAAQVEQQHKQGQSQAASSSSVTSPIKMKIPIANTEKYMADKKEKSGSLKLRIPIPPTDKSASKEELKMKIKVSSSERHSSSDEGSGKSKHSSPHISRDHKEKHKEHPSSRHHTSSHKHSHSHSGSSSGGSKHSADGIPPTVLRSPVGLSSDGISSSSSSSRKRLHVNDASHNHHSKMSKSSKSSGGLRTSQHPRETGQEASGDQRS

SEQ ID NO: 21155 - protein, 149 aa, Homo sapiens
  Payload ID: 4266
  Gene Symbol: CCNT2
  Gene Name: cyclin T2
  ENSP ID: ENSP00000387436
  MOD_RES (1)..(1): Any amino acid
XNSLHLTTFCLQYKPTVIACVCIHLACKWSNWEIPVSTDGKHWWEYVDPTVTLELLDELTHEFLQILEKTPNRLKKIRNWRANQAARKPKVDGQVGYGHLSTLVKLDKKPVETNGPDANHEYSTSSQHMDYKDTFDMLDSLLSAQGMNM

SEQ ID NO: 21156 - protein, 131 aa, Homo sapiens
  Payload ID: 4266
  Gene Symbol: CCNT2
  Gene Name: cyclin T2
  ENSP ID: ENSP00000399497
MLQTLASKDLAQTSYFMATNSLHLTTFCLQYKPTVIACVCIHLACKWSNWEIPVSTDGKHWWEYVDPTVTLELLDELTHEFLQILEKTPNRLKKIRNWRANQAARKPKVDGQVSETPLLGSSLVQNSILVD

SEQ ID NO: 21157 - protein, 173 aa, Homo sapiens
  Payload ID: 4266
  Gene Symbol: CCNT2
  Gene Name: cyclin T2
  ENSP ID: ENSP00000400298
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRDLWGIARNI

SEQ ID NO: 21158 - protein, 173 aa, Homo sapiens
  Payload ID: 4266
  Gene Symbol: CCNT2
  Gene Name: cyclin T2
  ENSP ID: ENSP00000402512
MASGRGASSRWFFTREQLENTPSRRCGVEADKELSCRQQAANLIQEMGQRLNVSQLTINTAIVYMHRFYMHHSFTKFNKNIISSTALFLAAKVEEQARKLEHVIKVAHACLHPLEPLLDTKCDAYLQQTQELVILETIMLQTLGFEITIEHPHTDVVKCTQLVRGECFIATFS

SEQ ID NO: 21159 - protein, 173 aa, Homo sapiens; identical to SEQ ID NO: 21157
  Payload ID: 4266
  Gene Symbol: CCNT2
  Gene Name: cyclin T2
  ENSP ID: ENSP00000404653

SEQ ID NO: 21160 - protein, 67 aa, Homo sapiens
  Payload ID: 4266
  Gene Symbol: CCNT2
  Gene Name: cyclin T2
  ENSP ID: ENSP00000415120
  MOD_RES (1)..(1): Any amino acid
XIPVSTDGKHWWEYVDPTVTLELLDELTHEFLQILEKTPNRLKKIRNWRVRELTGFNRISVFYVTFT

SEQ ID NO: 21161 - protein, 287 aa, Homo sapiens
  Payload ID: 4267
  Gene Symbol: CCNY
  Gene Name: cyclin Y
  Uniprot ID: Q8ND76
  ENSP ID: ENSP00000265375
MEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 21162 - protein, 316 aa, Homo sapiens
  Payload ID: 4267
  Gene Symbol: CCNY
  Gene Name: cyclin Y
  Uniprot ID: Q8ND76
  ENSP ID: ENSP00000344275
MGNTTSCCVSSSPKLRRNAHSRLESYRPDTDLSREDTGCNLQHISDRENIDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 21163 - protein, 341 aa, Homo sapiens
  Payload ID: 4267
  Gene Symbol: CCNY
  Gene Name: cyclin Y
  Uniprot ID: Q8ND76
  ENSP ID: ENSP00000363836
MGNTTSCCVSSSPKLRRNAHSRLESYRPDTDLSREDTGCNLQHISDRENIDDLNMEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAIVTLVYLERLLTYAEIDICPANWKRIVLGAILLASKVWDDQAVWNVDYCQILKDITVEDMNELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 21164 - protein, 287 aa, Homo sapiens; identical to SEQ ID NO: 21161
  Payload ID: 4267
  Gene Symbol: CCNY
  Gene Name: cyclin Y
  Uniprot ID: Q8ND76
  ENSP ID: ENSP00000363838

SEQ ID NO: 21165 - protein, 51 aa, Homo sapiens
  Payload ID: 4267
  Gene Symbol: CCNY
  Gene Name: cyclin Y
  ENSP ID: ENSP00000473487
MEFNPSDHPRASTIFLSKSQTDVREKRKSLFINHHPPGQIARKYSSCSTIF

SEQ ID NO: 21166 - protein, 101 aa, Homo sapiens
  Payload ID: 4267
  Gene Symbol: CCNY
  Gene Name: cyclin Y
  ENSP ID: ENSP00000473625
MEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSVI

SEQ ID NO: 21167 - protein, 359 aa, Homo sapiens
  Payload ID: 4268
  Gene Symbol: CCNYL1
  Gene Name: cyclin Y-like 1
  Uniprot ID: Q8N7R7
  ENSP ID: ENSP00000295414
MGNTLTCCVSPNASPKLGRRAGSAELYCASDIYEAVSGDAVAVAPAVVEPAELDFGEGEGHHLQHISDREMPEDLALESNPSDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 21168 - protein, 308 aa, Homo sapiens
  Payload ID: 4268
  Gene Symbol: CCNYL1
  Gene Name: cyclin Y-like 1
  Uniprot ID: Q8N7R7
  ENSP ID: ENSP00000342344
MGNTLTCCVSPNASPKLGRRAGSAELYCASDIYEAVSGDAVAVAPAVVEPAELDFGEGEGHHLQHISDREMPEDLALESNPSDHPRASTIFLSKSQTDVREKRKSNHLNHCDLSNILPHKEQREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 21169 - protein, 289 aa, Homo sapiens
  Payload ID: 4268
  Gene Symbol: CCNYL1
  Gene Name: cyclin Y-like 1
  Uniprot ID: Q8N7R7
  ENSP ID: ENSP00000376045
MPEDLALESNPSDHPRASTIFLSKSQTDVREKRKSNHLNHVSPGQLTKKYSSCSTIFLDDSTVSQPNLRTTVKCVTLAIYYHIKNRDANRSLDIFDERSHPLTREKVPEEYFKHDPEHKFIYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLEAISRLCEDKDLCRAAMRRSFSADNFIGIQRSKAILS

SEQ ID NO: 21170 - protein, 119 aa, Homo sapiens
  Payload ID: 4268
  Gene Symbol: CCNYL1
  Gene Name: cyclin Y-like 1
  ENSP ID: ENSP00000388992
  MOD_RES (1)..(1): Any amino acid
XREMPEDLALESNPSDHPRASTIFLSKSQTDVREKRKSNHLNHVSPGQLTKKYSSCSTIFLDDSTVSQPNLRTTVKCVTLAIYYHIKNSEKKFQRNTLSMILSTNLFTDLFVLFLVLHS

SEQ ID NO: 21171 - protein, 147 aa, Homo sapiens
  Payload ID: 4268
  Gene Symbol: CCNYL1
  Gene Name: cyclin Y-like 1
  ENSP ID: ENSP00000396072
IYRFVRTLFSAAQLTAECAIVTLVYLERLLTYAEIDICPTNWKRIVLGAILLASKVWDDQAVWNVDYCQILKDITVEDMNEMERHFLELLQFNINVPASVYAKYYFDLRSLADDNNLNFLFAPLSKERAQNLELVTLPFAPFSNGEK

SEQ ID NO: 21172 - protein, 101 aa, Homo sapiens
  Payload ID: 4268
  Gene Symbol: CCNYL1
  Gene Name: cyclin Y-like 1
  ENSP ID: ENSP00000399151
MGNTLTCCVSPNASPKLGRRAGSAELYCASDIYEAVSGDAVAVAPAVVEPAELDFGEGEGHHLQHISDREMPEEKESHCVDQAGLELLAWAQAVLPPQPPE

SEQ ID NO: 21173 - protein, 240 aa, Homo sapiens
  Payload ID: 4269
  Gene Symbol: CDK1
  Gene Name: cyclin-dependent kinase 1
  Uniprot ID: P06493
  ENSP ID: ENSP00000325970
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 21174 - protein, 240 aa, Homo sapiens; identical to SEQ ID NO: 21173
  Payload ID: 4269
  Gene Symbol: CDK1
  Gene Name: cyclin-dependent kinase 1
  Uniprot ID: P06493
  ENSP ID: ENSP00000362915

SEQ ID NO: 21175 - protein, 297 aa, Homo sapiens
  Payload ID: 4269
  Gene Symbol: CDK1
  Gene Name: cyclin-dependent kinase 1
  Uniprot ID: P06493
  ENSP ID: ENSP00000378699
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 21176 - protein, 297 aa, Homo sapiens
  Payload ID: 4269
  Gene Symbol: CDK1
  Gene Name: cyclin-dependent kinase 1
  ENSP ID: ENSP00000397973
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEAITLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 21177 - protein, 189 aa, Homo sapiens
  Payload ID: 4269
  Gene Symbol: CDK1
  Gene Name: cyclin-dependent kinase 1
  ENSP ID: ENSP00000430665
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWS

SEQ ID NO: 21178 - protein, 224 aa, Homo sapiens
  Payload ID: 4269
  Gene Symbol: CDK1
  Gene Name: cyclin-dependent kinase 1
  ENSP ID: ENSP00000482996
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRNFFPVF

SEQ ID NO: 21179 - protein, 313 aa, Homo sapiens
  Payload ID: 4270
  Gene Symbol: CDK10
  Gene Name: cyclin-dependent kinase 10
  ENSP ID: ENSP00000329957
MEPMYQDRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 21180 - protein, 360 aa, Homo sapiens
  Payload ID: 4270
  Gene Symbol: CDK10
  Gene Name: cyclin-dependent kinase 10
  Uniprot ID: Q15131
  ENSP ID: ENSP00000338673
MAEPDLECEQIRLKCIRKEGFFTVPPEHRLGRCRSVKEFEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLPCEPELMPTFPHHRNKRAAPATSEGQSKRCKP

SEQ ID NO: 21181 - protein, 69 aa, Homo sapiens
  Payload ID: 4270
  Gene Symbol: CDK10
  Gene Name: cyclin-dependent kinase 10
  ENSP ID: ENSP00000421597
MAEPDLECEQIRLKCIRKEGFFTVPPEHRGLALSPRLECSGVITAQCIVSLLGSSDLPASASQVLELQA

SEQ ID NO: 21182 - protein, 42 aa, Homo sapiens
  Payload ID: 4270
  Gene Symbol: CDK10
  Gene Name: cyclin-dependent kinase 10
  ENSP ID: ENSP00000423370
MAEPDLECEQIRLKCIRSSALAQAGMQWRDHGSVHRQPPGLK

SEQ ID NO: 21183 - protein, 272 aa, Homo sapiens
  Payload ID: 4270
  Gene Symbol: CDK10
  Gene Name: cyclin-dependent kinase 10
  Uniprot ID: Q15131
  ENSP ID: ENSP00000424415
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMYDPKKRATAGDCLESSYFKEKPLRLPISGVCEGCREPG

SEQ ID NO: 21184 - protein, 56 aa, Homo sapiens
  Payload ID: 4270
  Gene Symbol: CDK10
  Gene Name: cyclin-dependent kinase 10
  ENSP ID: ENSP00000426102
MAEPDLECEQIRLKCIHRGWMTTGATLYSSRRAAGAHRVESRVLDSGVKYWDDAGV

SEQ ID NO: 21185 - protein, 69 aa, Homo sapiens; identical to SEQ ID NO: 21181
  Payload ID: 4270
  Gene Symbol: CDK10
  Gene Name: cyclin-dependent kinase 10
  ENSP ID: ENSP00000426264

SEQ ID NO: 21186 - protein, 42 aa, Homo sapiens
  Payload ID: 4270
  Gene Symbol: CDK10
  Gene Name: cyclin-dependent kinase 10
  ENSP ID: ENSP00000455976
MAEPDLECEQIRLKCIRKEGFFTVPPEHRIGPGTPRQMRLSH

SEQ ID NO: 21187 - protein, 37 aa, Homo sapiens
  Payload ID: 4270
  Gene Symbol: CDK10
  Gene Name: cyclin-dependent kinase 10
  ENSP ID: ENSP00000456788
  MOD_RES (1)..(1): Any amino acid
XELLLGTTTQTTSIDMWAFPSCHWSASTASGSSPTTT

SEQ ID NO: 21188 - protein, 239 aa, Homo sapiens
  Payload ID: 4270
  Gene Symbol: CDK10
  Gene Name: cyclin-dependent kinase 10
  ENSP ID: ENSP00000457055
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWVSKGLAAVRSSVPRAGGVSRRLAAVRSTVLCRAVGCILAELLAHRPLLPGTSEIHQIDLIVQLLGTPSENIWPGFSKLPLVGQYSLR

SEQ ID NO: 21189 - protein, 272 aa, Homo sapiens; identical to SEQ ID NO: 21183
  Payload ID: 4270
  Gene Symbol: CDK10
  Gene Name: cyclin-dependent kinase 10
  Uniprot ID: Q15131
  ENSP ID: ENSP00000484357

SEQ ID NO: 21190 - protein, 42 aa, Homo sapiens; identical to SEQ ID NO: 21186
  Payload ID: 4270
  Gene Symbol: CDK10
  Gene Name: cyclin-dependent kinase 10
  ENSP ID: ENSP00000486594

SEQ ID NO: 21191 - protein, 746 aa, Homo sapiens
  Payload ID: 4271
  Gene Symbol: CDK11A
  Gene Name: cyclin-dependent kinase 11A
  ENSP ID: ENSP00000348529
MSQSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21192 - protein, 779 aa, Homo sapiens
  Payload ID: 4271
  Gene Symbol: CDK11A
  Gene Name: cyclin-dependent kinase 11A
  ENSP ID: ENSP00000350403
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21193 - protein, 770 aa, Homo sapiens
  Payload ID: 4271
  Gene Symbol: CDK11A
  Gene Name: cyclin-dependent kinase 11A
  Uniprot ID: Q9UQ88
  ENSP ID: ENSP00000351629
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21194 - protein, 783 aa, Homo sapiens
  Payload ID: 4271
  Gene Symbol: CDK11A
  Gene Name: cyclin-dependent kinase 11A
  Uniprot ID: Q9UQ88
  ENSP ID: ENSP00000367900
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPAPAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21195 - protein, 746 aa, Homo sapiens; identical to SEQ ID NO: 21191
  Payload ID: 4271
  Gene Symbol: CDK11A
  Gene Name: cyclin-dependent kinase 11A
  ENSP ID: ENSP00000367905

SEQ ID NO: 21196 - protein, 37 aa, Homo sapiens
  Payload ID: 4271
  Gene Symbol: CDK11A
  Gene Name: cyclin-dependent kinase 11A
  ENSP ID: ENSP00000383874
MGDEKDSWKVKTLDEILQEKKRRKEQEEKAEIKRLKN

SEQ ID NO: 21197 - protein, 780 aa, Homo sapiens
  Payload ID: 4271
  Gene Symbol: CDK11A
  Gene Name: cyclin-dependent kinase 11A
  Uniprot ID: Q9UQ88
  ENSP ID: ENSP00000384442
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21198 - protein, 420 aa, Homo sapiens
  Payload ID: 4271
  Gene Symbol: CDK11A
  Gene Name: cyclin-dependent kinase 11A
  ENSP ID: ENSP00000422149
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPAPAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGLPERRGVPVPEQDRGGHLWSGLQSKRQENR

SEQ ID NO: 21199 - protein, 151 aa, Homo sapiens
  Payload ID: 4271
  Gene Symbol: CDK11A
  Gene Name: cyclin-dependent kinase 11A
  ENSP ID: ENSP00000423900
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKWKHARVKEREHERRKRHREEQDKARREWERQKRREMAREHSRR

SEQ ID NO: 21200 - protein, 407 aa, Homo sapiens
  Payload ID: 4271
  Gene Symbol: CDK11A
  Gene Name: cyclin-dependent kinase 11A
  ENSP ID: ENSP00000462289
MGDEKDSWKVKTLDEILQEKKRRKEQEEKAEIKRLKNSDDRDSKRDSLEEGELRDHCMEITIRNSPYRREDSMEDRGEEDDSLAIKPPQQMSRKEKVHHRKDEKRKEKCRHHSHSAEGGKHARVKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGLPERRGVPVPEQDRGGHLWSGLQSKRQENR

SEQ ID NO: 21201 - protein, 782 aa, Homo sapiens
  Payload ID: 4272
  Gene Symbol: CDK11B
  Gene Name: cyclin-dependent kinase 11B
  ENSP ID: ENSP00000463048
MGDEKDSWKVKTLDEILQEKKRRKEQEEKAEIKRLKNSDDRDSKRDSLEEGELRDHRMEITIRNSPYRREDSMEDRGEEDDSLAIKPPQQMSRKEKAHHRKDEKRKEKRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21202 - protein, 748 aa, Homo sapiens
  Payload ID: 4272
  Gene Symbol: CDK11B
  Gene Name: cyclin-dependent kinase 11B
  ENSP ID: ENSP00000464016
MSQSDDRDSKRDSLEEGELRDHRMEITIRNSPYRREDSMEDRGEEDDSLAIKPPQQMSRKEKAHHRKDEKRKEKRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21203 - protein, 795 aa, Homo sapiens
  Payload ID: 4272
  Gene Symbol: CDK11B
  Gene Name: cyclin-dependent kinase 11B
  ENSP ID: ENSP00000464036
MGDEKDSWKVKTLDEILQEKKRRKEQEEKAEIKRLKNSDDRDSKRDSLEEGELRDHRMEITIRNSPYRREDSMEDRGEEDDSLAIKPPQQMSRKEKAHHRKDEKRKEKRRHRSHSAEGGKHARVKEKEREHERRKRHREEQDKARREWERQKRREMAREHSRRERDRLEQLERKRERERKMREQQKEQREQKERERRAEERRKEREARREVSAHHRTMREDYSDKVKASHWSRSPPRPPRERFELGDGRKPGEARPAPAQKPAQLKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21204 - protein, 203 aa, Homo sapiens
  Payload ID: 4272
  Gene Symbol: CDK11B
  Gene Name: cyclin-dependent kinase 11B
  ENSP ID: ENSP00000481846
MGDEKDSWKVKTLDEILQEKKRRKEQEEKAEIKRLKNSDDRDSKRDSLEEGELRDHRMEITIRNSPYRREDSMEDRGEEDDSLAIKPPQQMSRKEKAHHRKDEKRKEKRRHRSHSAEGGKHARVKEKEREHERRKRHREEQDKARREWERQKRREMAREHSRRESKRRENGRKGPAVRLTGHQRQREEDQLGRVLVSGIRLRF

SEQ ID NO: 21205 - protein, 244 aa, Homo sapiens
  Payload ID: 4272
  Gene Symbol: CDK11B
  Gene Name: cyclin-dependent kinase 11B
  ENSP ID: ENSP00000484222
MGDEKDSWKVKTLDEILQEKKRRKEQEEKAEIKRLKNSDDRDSKRDSLEEGELRDHRMEITIRNSPYRREDSMEDRGEEDDSLAIKPPQQMSRKEKAHHRKDEKRKEKRRHRSHSAEGGKHARVKEKEREHERRKRHREEQDKARREWERQKRREMAREHSRRESVCTSPNDERGLQRQSESQPLESQPASAAAGAVRVGRRPEASKRRENGRKGPAVRLTGHQRQREEDQLGRVLVSGIRLRF

SEQ ID NO: 21206 - protein, 772 aa, Homo sapiens
  Payload ID: 4272
  Gene Symbol: CDK11B
  Gene Name: cyclin-dependent kinase 11B
  ENSP ID: ENSP00000485705
MGDEKDSWKVKTLDEILQEKKRRKEQEEKAEIKRLKNSDDRDSKRDSLEEGELRDHRMEITIRNSPYRREDSMEDRTGKDAALGDKPRPCLKKKLETRRSKDFTARNRPIQQEDTAMIRHFEKRRQADHEVRRLRPSWLTCKLLFRGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21207 - protein, 785 aa, Homo sapiens
  Payload ID: 4272
  Gene Symbol: CDK11B
  Gene Name: cyclin-dependent kinase 11B
  ENSP ID: ENSP00000485849
MGDEKDSWKVKTLDEILQEKKRRKEQEEKAEIKRLKNSDDRDSKRDSLEEGELRDHRMEITIRNSPYRREDSMEDRNQPGQHGETLSLQKSPGLGDKPRPCLKKKLETRRSKDFTARNRPIQQEDTAMIRHFEKRRQADHEAEAGESLEPGRRSKLLFRGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21208 - protein, 783 aa, Homo sapiens
  Payload ID: 4272
  Gene Symbol: CDK11B
  Gene Name: cyclin-dependent kinase 11B
  ENSP ID: ENSP00000485937
MGDEKDSWKVKTLDEILQEKKRRKEQEEKAEIKRLKNSDDRDSKRDSLEEGELRDHRMEITIRNSPYRREDSMEDRKTRSNCMLSAREQEKTQRTNISSTREAQTLSQKKARNKKEQGLHSQKQANTAGRYSNDTSTREAEAGESLEPGRRSKLLFRGNDGVCLFRDRLEQLERKRERERKMREQQKEQREQKERERRAEERRKEREARREVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALSPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTLWYRAPELLLGAKEYSTAVDMWSVGCIFGELLTQKPLFPGKSEIDQINKVFKDLGTPSEKIWPGYSELPAVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 21209 - protein, 1490 aa, Homo sapiens
  Payload ID: 4273
  Gene Symbol: CDK12
  Gene Name: cyclin-dependent kinase 12
  Uniprot ID: Q9NYV4
  ENSP ID: ENSP00000398880
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 21210 - protein, 1481 aa, Homo sapiens
  Payload ID: 4273
  Gene Symbol: CDK12
  Gene Name: cyclin-dependent kinase 12
  Uniprot ID: Q9NYV4
  ENSP ID: ENSP00000407720
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 21211 - protein, 159 aa, Homo sapiens
  Payload ID: 4273
  Gene Symbol: CDK12
  Gene Name: cyclin-dependent kinase 12
  ENSP ID: ENSP00000453329
  MOD_RES (1)..(1): Any amino acid
XADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAGRSNGGNAL

SEQ ID NO: 21212 - protein, 1201 aa, Homo sapiens
  Payload ID: 4273
  Gene Symbol: CDK12
  Gene Name: cyclin-dependent kinase 12
  ENSP ID: ENSP00000464641
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASST

SEQ ID NO: 21213 - protein, 1512 aa, Homo sapiens
  Payload ID: 4274
  Gene Symbol: CDK13
  Gene Name: cyclin-dependent kinase 13
  Uniprot ID: Q14004
  ENSP ID: ENSP00000181839
MPSSSDTALGGGGGLSWAEKKLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPVKTGPGQHLNHSELAILLNLLQSKTSVNMADFVQVLNIKVNSETQQQLNKINLPAGILATGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 21214 - protein, 1452 aa, Homo sapiens
  Payload ID: 4274
  Gene Symbol: CDK13
  Gene Name: cyclin-dependent kinase 13
  Uniprot ID: Q14004
  ENSP ID: ENSP00000340557
MPSSSDTALGGGGGLSWAEKKLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSGGRRKSASATSSSSSSRKDRDSKAHRSRTKSSKEPPSAYKEPPKAYREDKTEPKAYRRRRSLSPLGGRDDSPVSHRASQSLRSRKSPSPAGGGSSPYSRRLPRSPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGGIQPSSQTIQPKVETDAAQAAVQSAFAVLLTQLIKAQQSKQKDVLLEERENGSGHEASLQLRPPPEPSTPVSGQDDLIQHQDMRILELTPEPDRPRILPPDQRPPEPPEPPPVTEEDLDYRTENQHVPTTSSSLTDPHAGVKAALLQLLAQHQPQDDPKREGGIDYQAGDTYVSTSDYKDNFGSSSFSSAPYVSNDGLGSSSAPPLERRSFIGNSDIQSLDNYSTASSHSGGPPQPSAFSESFPSSVAGYGDIYLNAGPMLFSGDKDHRFEYSHGPIAVLANSSDPSTGPESTHPLPAKMHNYNYGGNLQENPSGPSLMHGQTWTSPAQGPGYSQGYRGHISTSTGRGRGRGLPY

SEQ ID NO: 21215 - protein, 324 aa, Homo sapiens
  Payload ID: 4274
  Gene Symbol: CDK13
  Gene Name: cyclin-dependent kinase 13
  ENSP ID: ENSP00000480835
MLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELIRHEENEVSDKQI

SEQ ID NO: 21216 - protein, 418 aa, Homo sapiens
  Payload ID: 4274
  Gene Symbol: CDK13
  Gene Name: cyclin-dependent kinase 13
  ENSP ID: ENSP00000484610
MLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKCLHQISLYGKIVMSYGVKSEEDRSRWA

SEQ ID NO: 21217 - protein, 451 aa, Homo sapiens
  Payload ID: 4275
  Gene Symbol: CDK14
  Gene Name: cyclin-dependent kinase 14
  Uniprot ID: O94921
  ENSP ID: ENSP00000265741
MHGYFGCNAAAEPGYSAFVGTPQICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 21218 - protein, 469 aa, Homo sapiens
  Payload ID: 4275
  Gene Symbol: CDK14
  Gene Name: cyclin-dependent kinase 14
  Uniprot ID: O94921
  ENSP ID: ENSP00000369390
MCDLIEPQPAEKIGKMKKLRRTLSESFSRIALKKDDTTFDEICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 21219 - protein, 423 aa, Homo sapiens
  Payload ID: 4275
  Gene Symbol: CDK14
  Gene Name: cyclin-dependent kinase 14
  Uniprot ID: O94921
  ENSP ID: ENSP00000385034
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 21220 - protein, 113 aa, Homo sapiens
  Payload ID: 4275
  Gene Symbol: CDK14
  Gene Name: cyclin-dependent kinase 14
  ENSP ID: ENSP00000387794
MSTRNCQGMDSVIKPLDTIPEDKKVRVQRTQSTFDPFEKPANQVKRVHSENNACINFKTSSTGKESPKVRRHSSPSSGKWEVGSSEGDQAAGRRRDTFHSYQGSFSFKRTKTC

SEQ ID NO: 21221 - protein, 127 aa, Homo sapiens
  Payload ID: 4275
  Gene Symbol: CDK14
  Gene Name: cyclin-dependent kinase 14
  ENSP ID: ENSP00000393616
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEG

SEQ ID NO: 21222 - protein, 127 aa, Homo sapiens; identical to SEQ ID NO: 21221
  Payload ID: 4275
  Gene Symbol: CDK14
  Gene Name: cyclin-dependent kinase 14
  ENSP ID: ENSP00000394570

SEQ ID NO: 21223 - protein, 340 aa, Homo sapiens
  Payload ID: 4275
  Gene Symbol: CDK14
  Gene Name: cyclin-dependent kinase 14
  ENSP ID: ENSP00000398936
MLALTLRPPPLAKSHLKLGGTPAPARVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 21224 - protein, 92 aa, Homo sapiens
  Payload ID: 4275
  Gene Symbol: CDK14
  Gene Name: cyclin-dependent kinase 14
  ENSP ID: ENSP00000401603
MSTRNCQGMDSVIKPLDTIPEDKKVRVQRTQSTFDPFEKPANQVKRVHSENNACINFKTSSTGKESPKVRRHSSPSSPTSPKFGKADSYEKL

SEQ ID NO: 21225 - protein, 127 aa, Homo sapiens; identical to SEQ ID NO: 21221
  Payload ID: 4275
  Gene Symbol: CDK14
  Gene Name: cyclin-dependent kinase 14
  ENSP ID: ENSP00000406848

SEQ ID NO: 21226 - protein, 127 aa, Homo sapiens; identical to SEQ ID NO: 21221
  Payload ID: 4275
  Gene Symbol: CDK14
  Gene Name: cyclin-dependent kinase 14
  ENSP ID: ENSP00000410770

SEQ ID NO: 21227 - protein, 384 aa, Homo sapiens
  Payload ID: 4276
  Gene Symbol: CDK15
  Gene Name: cyclin-dependent kinase 15
  Uniprot ID: Q96Q40
  ENSP ID: ENSP00000260967
MTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 21228 - protein, 384 aa, Homo sapiens; identical to SEQ ID NO: 21227
  Payload ID: 4276
  Gene Symbol: CDK15
  Gene Name: cyclin-dependent kinase 15
  Uniprot ID: Q96Q40
  ENSP ID: ENSP00000386901

SEQ ID NO: 21229 - protein, 54 aa, Homo sapiens
  Payload ID: 4276
  Gene Symbol: CDK15
  Gene Name: cyclin-dependent kinase 15
  ENSP ID: ENSP00000389831
MTSFHPRGLQAARAQKFKSKRPRSNSDCFQEEDLRQGFQWSRGRASLLGQPHLT

SEQ ID NO: 21230 - protein, 429 aa, Homo sapiens
  Payload ID: 4276
  Gene Symbol: CDK15
  Gene Name: cyclin-dependent kinase 15
  Uniprot ID: Q96Q40
  ENSP ID: ENSP00000406472
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDVSGVRLKPEMCDLLASYQKGHHPAQFSKCW

SEQ ID NO: 21231 - protein, 400 aa, Homo sapiens
  Payload ID: 4276
  Gene Symbol: CDK15
  Gene Name: cyclin-dependent kinase 15
  Uniprot ID: Q96Q40
  ENSP ID: ENSP00000412775
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDE

SEQ ID NO: 21232 - protein, 570 aa, Homo sapiens
  Payload ID: 4277
  Gene Symbol: CDK16
  Gene Name: cyclin-dependent kinase 16
  Uniprot ID: Q00536
  ENSP ID: ENSP00000276052
MPLYGRARDHVTHPSILGTRPGRPMAGPITAAVPEKICNGAFCSCSGAFPLDPNNPSLGPLPSISHLNLRTQIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 21233 - protein, 496 aa, Homo sapiens [sequence omitted]

SEQ ID NO: 21234 - protein, 502 aa, Homo sapiens
  Payload ID: 4277
  Gene Symbol: CDK16
  Gene Name: cyclin-dependent kinase 16
  Uniprot ID: Q00536
  ENSP ID: ENSP00000405798
MQSEIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 21235 - protein, 260 aa, Homo sapiens
  Payload ID: 4277
  Gene Symbol: CDK16
  Gene Name: cyclin-dependent kinase 16
  ENSP ID: ENSP00000428349
DKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRSLCPCGRLDSDGADLLTKLLQFEGRNRISAEDAMKHPFFLSLGERIHKLPDTTSIFALKEIQLQKEASLRSSSMPDSGRPAFRVVDTEF

SEQ ID NO: 21236 - protein, 153 aa, Homo sapiens
  Payload ID: 4277
  Gene Symbol: CDK16
  Gene Name: cyclin-dependent kinase 16
  ENSP ID: ENSP00000428351
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVS

SEQ ID NO: 21237 - protein, 189 aa, Homo sapiens
  Payload ID: 4277
  Gene Symbol: CDK16
  Gene Name: cyclin-dependent kinase 16
  ENSP ID: ENSP00000429044
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDN

SEQ ID NO: 21238 - protein, 150 aa, Homo sapiens
  Payload ID: 4277
  Gene Symbol: CDK16
  Gene Name: cyclin-dependent kinase 16
  ENSP ID: ENSP00000429259
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLR

SEQ ID NO: 21239 - protein, 496 aa, Homo sapiens [sequence omitted]

SEQ ID NO: 21240 - protein, 393 aa, Homo sapiens
  Payload ID: 4277
  Gene Symbol: CDK16
  Gene Name: cyclin-dependent kinase 16
  ENSP ID: ENSP00000429985
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILVFCAMKPCSQPFRDR

SEQ ID NO: 21241 - protein, 152 aa, Homo sapiens
  Payload ID: 4277
  Gene Symbol: CDK16
  Gene Name: cyclin-dependent kinase 16
  ENSP ID: ENSP00000430486
  MOD_RES (1)..(1): Any amino acid
XPEQIGLDESGGGGGSDPGEAPTRAAPGELRSARGPLSSAPEIVHEDLKMGSDGESDQASATSSDEVQSPVRDINKRLSLPADIRLPEGYLEKLTLNSPIFDKPLSRRLRRVSLSEIGFGKLETYIKLDKLGEGTYATVYKGKSKLTDNLVA

SEQ ID NO: 21242 - protein, 84 aa, Homo sapiens
  Payload ID: 4277
  Gene Symbol: CDK16
  Gene Name: cyclin-dependent kinase 16
  ENSP ID: ENSP00000430824
  MOD_RES (1)..(1): Any amino acid
XLDSDGADLLTKLLQFEGRNRISAEDAMKHPFFLSLGERIHKLPDTTSIFALKEIQLQKEASLRSSSMPDSVAGGQHGRASLPH

SEQ ID NO: 21243 - protein, 83 aa, Homo sapiens
  Payload ID: 4277
  Gene Symbol: CDK16
  Gene Name: cyclin-dependent kinase 16
  ENSP ID: ENSP00000430966
MQSEIAMDRMKKIKRQLSMTLRGGRGIDKTNGAPEQIGLDESGGGGGSDPGEAPTRAAPGELRSARGPLSSAPDCARGLEDGV

SEQ ID NO: 21244 - protein, 166 aa, Homo sapiens
  Payload ID: 4277
  Gene Symbol: CDK16
  Gene Name: cyclin-dependent kinase 16
  ENSP ID: ENSP00000430988
  MOD_RES (1)..(1): Any amino acid
XLDSDGADLLTKLLQFEGRNRISAEDAMKHPFFLSLGERIHKLPDTTSIFALKEIQLQKEASLRSSSMPDSAICSAFPHRQASFPRGGHRVLSHRPRPQQAAAGGMPHPSQGSPQLHLPCLLSAYLPEPCSPAHLSPAACPNTPPLACQPTHWPVCWVLTKLSSLL

SEQ ID NO: 21245 - protein, 57 aa, Homo sapiens
  Payload ID: 4277
  Gene Symbol: CDK16
  Gene Name: cyclin-dependent kinase 16
  ENSP ID: ENSP00000431085
MDRMKKIKRQLSMTLRGGRGIDKTNGAPEQIGLDESGGGGGSDPGEAPTRAAPGELR

SEQ ID NO: 21246 - protein, 448 aa, Homo sapiens
  Payload ID: 4277
  Gene Symbol: CDK16
  Gene Name: cyclin-dependent kinase 16
  ENSP ID: ENSP00000482886
MDRMKKIKRQLSMTLRSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 21247 - protein, 523 aa, Homo sapiens
  Payload ID: 4278
  Gene Symbol: CDK17
  Gene Name: cyclin-dependent kinase 17
  Uniprot ID: Q00537
  ENSP ID: ENSP00000261211
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGHGKNRRQSMLF

SEQ ID NO: 21248 - protein, 470 aa, Homo sapiens
  Payload ID: 4278
  Gene Symbol: CDK17
  Gene Name: cyclin-dependent kinase 17
  ENSP ID: ENSP00000442926
MHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGVFVINHFTCRS

SEQ ID NO: 21249 - protein, 523 aa, Homo sapiens
  Payload ID: 4278
  Gene Symbol: CDK17
  Gene Name: cyclin-dependent kinase 17
  Uniprot ID: Q00537
  ENSP ID: ENSP00000444459
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGVFVINHFTCRS

SEQ ID NO: 21250 - protein, 161 aa, Homo sapiens
  Payload ID: 4278
  Gene Symbol: CDK17
  Gene Name: cyclin-dependent kinase 17
  ENSP ID: ENSP00000447282
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKL

SEQ ID NO: 21251 - protein, 129 aa, Homo sapiens
  Payload ID: 4278
  Gene Symbol: CDK17
  Gene Name: cyclin-dependent kinase 17
  ENSP ID: ENSP00000447441
MMPNKYSIIRRFFKPHSIDRMKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGES

SEQ ID NO: 21252 - protein, 88 aa, Homo sapiens
  Payload ID: 4278
  Gene Symbol: CDK17
  Gene Name: cyclin-dependent kinase 17
  ENSP ID: ENSP00000448132
MKKFKRRLSLTLRGSQTIDESLSELAEQMTIEENSSKDNEPIVKNGRPPTSHSMHSFLHQYTGSFKKPPLRRPHSVIGGSLGSFMAMP

SEQ ID NO: 21253 - protein, 179 aa, Homo sapiens
  Payload ID: 4278
  Gene Symbol: CDK17
  Gene Name: cyclin-dependent kinase 17
  ENSP ID: ENSP00000450058
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRA

SEQ ID NO: 21254 - protein, 474 aa, Homo sapiens
  Payload ID: 4279
  Gene Symbol: CDK18
  Gene Name: cyclin-dependent kinase 18
  Uniprot ID: Q07002
  ENSP ID: ENSP00000353176
MIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 21255 - protein, 283 aa, Homo sapiens
  Payload ID: 4279
  Gene Symbol: CDK18
  Gene Name: cyclin-dependent kinase 18
  ENSP ID: ENSP00000391324
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGL

SEQ ID NO: 21256 - protein, 159 aa, Homo sapiens
  Payload ID: 4279
  Gene Symbol: CDK18
  Gene Name: cyclin-dependent kinase 18
  ENSP ID: ENSP00000397831
MIMNKMKNFKRRFSLSVPRTETIEESLAEFTEQFNQLHNRRNENSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKL

SEQ ID NO: 21257 - protein, 474 aa, Homo sapiens; identical to SEQ ID NO: 21254
  Payload ID: 4279
  Gene Symbol: CDK18
  Gene Name: cyclin-dependent kinase 18
  Uniprot ID: Q07002
  ENSP ID: ENSP00000399082

SEQ ID NO: 21258 - protein, 72 aa, Homo sapiens [sequence omitted]

SEQ ID NO: 21259 - protein, 72 aa, Homo sapiens [sequence omitted]

SEQ ID NO: 21260 - protein, 180 aa, Homo sapiens
  Payload ID: 4279
  Gene Symbol: CDK18
  Gene Name: cyclin-dependent kinase 18
  ENSP ID: ENSP00000423408
MEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQ

SEQ ID NO: 21261 - protein, 504 aa, Homo sapiens
  Payload ID: 4279
  Gene Symbol: CDK18
  Gene Name: cyclin-dependent kinase 18
  Uniprot ID: Q07002
  ENSP ID: ENSP00000423665
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 21262 - protein, 72 aa, Homo sapiens [sequence omitted]

SEQ ID NO: 21263 - protein, 72 aa, Homo sapiens [sequence omitted]

SEQ ID NO: 21264 - protein, 64 aa, Homo sapiens
  Payload ID: 4279
  Gene Symbol: CDK18
  Gene Name: cyclin-dependent kinase 18
  ENSP ID: ENSP00000426368
MEVRASGALPRQVAGCTHKGVHRRAAALQPDFDVSKRLSLPMDIRLPQEFLQKLQMESPDLPKP

SEQ ID NO: 21265 - protein, 442 aa, Homo sapiens
  Payload ID: 4280
  Gene Symbol: CDK19
  Gene Name: cyclin-dependent kinase 19
  Uniprot ID: Q9BWU1
  ENSP ID: ENSP00000317665
MSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 21266 - protein, 502 aa, Homo sapiens
  Payload ID: 4280
  Gene Symbol: CDK19
  Gene Name: cyclin-dependent kinase 19
  Uniprot ID: Q9BWU1
  ENSP ID: ENSP00000357907
MDYDFKAKLAAERERVEDLFEYEGCKVGRGTYGHVYKARRKDGKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 21267 - protein, 398 aa, Homo sapiens
  Payload ID: 4280
  Gene Symbol: CDK19
  Gene Name: cyclin-dependent kinase 19
  ENSP ID: ENSP00000410604
MSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 21268 - protein, 251 aa, Homo sapiens
  Payload ID: 4280
  Gene Symbol: CDK19
  Gene Name: cyclin-dependent kinase 19
  ENSP ID: ENSP00000415621
MSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLL

SEQ ID NO: 21269 - protein, 122 aa, Homo sapiens
  Payload ID: 4280
  Gene Symbol: CDK19
  Gene Name: cyclin-dependent kinase 19
  ENSP ID: ENSP00000434476
  MOD_RES (1)..(1): Any amino acid
XKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLLTWVLPDYSILL

SEQ ID NO: 21270 - protein, 264 aa, Homo sapiens
  Payload ID: 4281
  Gene Symbol: CDK2
  Gene Name: cyclin-dependent kinase 2
  Uniprot ID: P24941
  ENSP ID: ENSP00000243067
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 21271 - protein, 298 aa, Homo sapiens
  Payload ID: 4281
  Gene Symbol: CDK2
  Gene Name: cyclin-dependent kinase 2
  Uniprot ID: P24941
  ENSP ID: ENSP00000266970
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 21272 - protein, 238 aa, Homo sapiens
  Payload ID: 4281
  Gene Symbol: CDK2
  Gene Name: cyclin-dependent kinase 2
  ENSP ID: ENSP00000393605
MENFQKVEKIGEGTYGVVYKARNKLTGEVVALKKIRLDTLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 21273 - protein, 39 aa, Homo sapiens
  Payload ID: 4281
  Gene Symbol: CDK2
  Gene Name: cyclin-dependent kinase 2
  ENSP ID: ENSP00000450983
MENFQKVEKIGEGTYGVVYKARNKLTGEVVALKKIRLDT

SEQ ID NO: 21274 - protein, 39 aa, Homo sapiens; identical to SEQ ID NO: 21273
  Payload ID: 4281
  Gene Symbol: CDK2
  Gene Name: cyclin-dependent kinase 2
  ENSP ID: ENSP00000452138

SEQ ID NO: 21275 - protein, 346 aa, Homo sapiens
  Payload ID: 4281
  Gene Symbol: CDK2
  Gene Name: cyclin-dependent kinase 2
  ENSP ID: ENSP00000452514
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMHLVGTQHHARCCGEHRRNGRQSLCPLCSYLEVAASQGWGMTAVSTPYPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 21276 - protein, 115 aa, Homo sapiens
  Payload ID: 4282
  Gene Symbol: CDK2AP1
  Gene Name: cyclin-dependent kinase 2 associated protein 1
  Uniprot ID: O14519
  ENSP ID: ENSP00000261692
MSYKPNLAAHMPAAALNAAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 21277 - protein, 87 aa, Homo sapiens
  Payload ID: 4282
  Gene Symbol: CDK2AP1
  Gene Name: cyclin-dependent kinase 2 associated protein 1
  Uniprot ID: O14519
  ENSP ID: ENSP00000438561
MATSSQYRQLLSDYGPPSLGYTQGTGNSQVPQSKYAELLAIIEELGKEIRPTYAGSKSAMERLKRGIIHARGLVRECLAETERNARS

SEQ ID NO: 21278 - protein, 87 aa, Homo sapiens; identical to SEQ ID NO: 21277
  Payload ID: 4282
  Gene Symbol: CDK2AP1
  Gene Name: cyclin-dependent kinase 2 associated protein 1
  Uniprot ID: O14519
  ENSP ID: ENSP00000440729

SEQ ID NO: 21279 - protein, 87 aa, Homo sapiens; identical to SEQ ID NO: 21277
  Payload ID: 4282
  Gene Symbol: CDK2AP1
  Gene Name: cyclin-dependent kinase 2 associated protein 1
  Uniprot ID: O14519
  ENSP ID: ENSP00000442502

SEQ ID NO: 21280 - protein, 87 aa, Homo sapiens; identical to SEQ ID NO: 21277
  Payload ID: 4282
  Gene Symbol: CDK2AP1
  Gene Name: cyclin-dependent kinase 2 associated protein 1
  Uniprot ID: O14519
  ENSP ID: ENSP00000442565

SEQ ID NO: 21281 - protein, 66 aa, Homo sapiens
  Payload ID: 4282
  Gene Symbol: CDK2AP1
  Gene Name: cyclin-dependent kinase 2 associated protein 1
  ENSP ID: ENSP00000444499
MATSSQYRQLLSDYGPPSLGYTQGTGNSQVPQSKYAELLAIIEELGKEIRPTYAGSKSAMERLKRG

SEQ ID NO: 21282 - protein, 87 aa, Homo sapiens; identical to SEQ ID NO: 21277
  Payload ID: 4282
  Gene Symbol: CDK2AP1
  Gene Name: cyclin-dependent kinase 2 associated protein 1
  Uniprot ID: O14519
  ENSP ID: ENSP00000479982

SEQ ID NO: 21283 - protein, 126 aa, Homo sapiens
  Payload ID: 4283
  Gene Symbol: CDK2AP2
  Gene Name: cyclin-dependent kinase 2 associated protein 2
  Uniprot ID: O75956
  ENSP ID: ENSP00000301488
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRGIIHARALVRECLAETERNART

SEQ ID NO: 21284 - protein, 106 aa, Homo sapiens
  Payload ID: 4283
  Gene Symbol: CDK2AP2
  Gene Name: cyclin-dependent kinase 2 associated protein 2
  ENSP ID: ENSP00000431503
MSYKPIAPAPSSTPGSSTPGPGTPVPTGSVPSPSGSVPGAGAPFRPLFNDFGPPSMGYVQAMKPPGAQGSQSTYTDLLSVIEEMGKEIRPTYAGSKSAMERLKRGK

SEQ ID NO: 21285 - protein, 61 aa, Homo sapiens
  Payload ID: 4283
  Gene Symbol: CDK2AP2
  Gene Name: cyclin-dependent kinase 2 associated protein 2
  ENSP ID: ENSP00000436213
MSYKPIAPAPSSTPGSSTPGPGTPVPTGEDPAPPLLACRAVEVSKRRRPEFCNTGPAAYPR

SEQ ID NO: 21286 - protein, 212 aa, Homo sapiens
  Payload ID: 4284
  Gene Symbol: CINP
  Gene Name: cyclin-dependent kinase 2 interacting protein
  Uniprot ID: Q9BW66
  ENSP ID: ENSP00000216756
MEAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 21287 - protein, 227 aa, Homo sapiens
  Payload ID: 4284
  Gene Symbol: CINP
  Gene Name: cyclin-dependent kinase 2 interacting protein
  Uniprot ID: Q9BW66
  ENSP ID: ENSP00000442057
MNGTIYANECQQIRHPNSKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 21288 - protein, 118 aa, Homo sapiens
  Payload ID: 4284
  Gene Symbol: CINP
  Gene Name: cyclin-dependent kinase 2 interacting protein
  Uniprot ID: Q9BW66
  ENSP ID: ENSP00000442377
MEAKTLGTVTPRKPVLSVSARKIKDNAADWHNLILKWETLNDAGFTTANNIANLKISLLNKDKIELDSSSPASKENEEKVCLEYNEELEKLCEELQATLDGLMRFRISSWRCTGRSCS

SEQ ID NO: 21289 - protein, 113 aa, Homo sapiens
  Payload ID: 4284
  Gene Symbol: CINP
  Gene Name: cyclin-dependent kinase 2 interacting protein
  ENSP ID: ENSP00000452982
MEAKTLGTVTPRKPVLSVSARKIKDNAADWHNLILKWETLNDAGFTTANNIANLKISLLNKDKIELDSSSPASKENEEKVCLEYNEELEKLCEELQATLDGLRMVSRPGLCLS

SEQ ID NO: 21290 - protein, 212 aa, Homo sapiens; identical to SEQ ID NO: 21286
  Payload ID: 4284
  Gene Symbol: CINP
  Gene Name: cyclin-dependent kinase 2 interacting protein
  Uniprot ID: Q9BW66
  ENSP ID: ENSP00000453839

SEQ ID NO: 21291 - protein, 213 aa, Homo sapiens
  Payload ID: 4284
  Gene Symbol: CINP
  Gene Name: cyclin-dependent kinase 2 interacting protein
  ENSP ID: ENSP00000453846
  MOD_RES (1)..(1): Any amino acid
XLSAKTLGTVTPRKPVLSVSARKIKDNAADWHNLILKWETLNDAGFTTANNIANLKISLLNKDKIELDSSSPASKENEEKVCLEYNEELEKLCEELQATLDGLTKIQVKMEKLSSTTKGICELENYHYGEESKRPPLFHTWPTTHFYEVSHKLLEMYRKELLLKRTVAKELAHTGDPDLTLSYLSMWLHQPYVESDSRLHLESMLLETGHRAL

SEQ ID NO: 21292 - protein, 346 aa, Homo sapiens
  Payload ID: 4285
  Gene Symbol: CDK20
  Gene Name: cyclin-dependent kinase 20
  Uniprot ID: Q8IZL9
  ENSP ID: ENSP00000322343
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRWYRAPELLYGARQYDQGVDLWSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 21293 - protein, 338 aa, Homo sapiens
  Payload ID: 4285
  Gene Symbol: CDK20
  Gene Name: cyclin-dependent kinase 20
  Uniprot ID: Q8IZL9
  ENSP ID: ENSP00000338975
MDQYCILGRIGEGAHGIVFKAKHVEPRVGWQCLPSILQTGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 21294 - protein, 243 aa, Homo sapiens
  Payload ID: 4285
  Gene Symbol: CDK20
  Gene Name: cyclin-dependent kinase 20
  Uniprot ID: Q8IZL9
  ENSP ID: ENSP00000365031
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSSLSCRTTTRSPLRSRCPCPWRRCCLTSLPRHWICWVNSFSTLLTSASQLPRLSSISTSSQLPCLPIHLSCRFLSV

SEQ ID NO: 21295 - protein, 325 aa, Homo sapiens
  Payload ID: 4285
  Gene Symbol: CDK20
  Gene Name: cyclin-dependent kinase 20
  Uniprot ID: Q8IZL9
  ENSP ID: ENSP00000365043
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 21296 - protein, 275 aa, Homo sapiens
  Payload ID: 4285
  Gene Symbol: CDK20
  Gene Name: cyclin-dependent kinase 20
  Uniprot ID: Q8IZL9
  ENSP ID: ENSP00000474485
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKLPCLPIHLSCRFLSV

SEQ ID NO: 21297 - protein, 305 aa, Homo sapiens
  Payload ID: 4286
  Gene Symbol: CDK3
  Gene Name: cyclin-dependent kinase 3
  Uniprot ID: Q00526
  ENSP ID: ENSP00000410561
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 21298 - protein, 213 aa, Homo sapiens
  Payload ID: 4286
  Gene Symbol: CDK3
  Gene Name: cyclin-dependent kinase 3
  ENSP ID: ENSP00000465062
MEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVP

SEQ ID NO: 21299 - protein, 164 aa, Homo sapiens
  Payload ID: 4286
  Gene Symbol: CDK3
  Gene Name: cyclin-dependent kinase 3
  ENSP ID: ENSP00000466237
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVV

SEQ ID NO: 21300 - protein, 303 aa, Homo sapiens
  Payload ID: 4287
  Gene Symbol: CDK4
  Gene Name: cyclin-dependent kinase 4
  Uniprot ID: P11802
  ENSP ID: ENSP00000257904
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 21301 - protein, 111 aa, Homo sapiens
  Payload ID: 4287
  Gene Symbol: CDK4
  Gene Name: cyclin-dependent kinase 4
  ENSP ID: ENSP00000316889
MATSRYEPVAEIGVGAYGTVYKARDPHSGHFVALKSVRVPNGGGGGGGLPISTVREVALLRRLEAFEHPNVVRLMDVCATSRTDREIKRCFVESLSSVETLKPTSWAKSLT

SEQ ID NO: 21302 - protein, 115 aa, Homo sapiens
  Payload ID: 4287
  Gene Symbol: CDK4
  Gene Name: cyclin-dependent kinase 4
  ENSP ID: ENSP00000446763
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAE

SEQ ID NO: 21303 - protein, 40 aa, Homo sapiens
  Payload ID: 4287
  Gene Symbol: CDK4
  Gene Name: cyclin-dependent kinase 4
  ENSP ID: ENSP00000447005
MEESGAQLLLEMLTFNPHKRISAFRALQHSYLHKDEGNPE

SEQ ID NO: 21304 - protein, 186 aa, Homo sapiens
  Payload ID: 4287
  Gene Symbol: CDK4
  Gene Name: cyclin-dependent kinase 4
  ENSP ID: ENSP00000447274
MDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSV

SEQ ID NO: 21305 - protein, 208 aa, Homo sapiens
  Payload ID: 4287
  Gene Symbol: CDK4
  Gene Name: cyclin-dependent kinase 4
  ENSP ID: ENSP00000447779
MDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHK

SEQ ID NO: 21306 - protein, 201 aa, Homo sapiens
  Payload ID: 4287
  Gene Symbol: CDK4
  Gene Name: cyclin-dependent kinase 4
  ENSP ID: ENSP00000448098
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVTRACCVAQAGLQWHDHSSLQLQPPGLK

SEQ ID NO: 21307 - protein, 74 aa, Homo sapiens
  Payload ID: 4287
  Gene Symbol: CDK4
  Gene Name: cyclin-dependent kinase 4
  ENSP ID: ENSP00000448885
MATSRYEPVAEIGVGAYGTVYKARDPHSGHFVALKSVRVPNGGGGGGGLPISTVREVALLRRLEAFEHPNVVRI

SEQ ID NO: 21308 - protein, 170 aa, Homo sapiens
  Payload ID: 4287
  Gene Symbol: CDK4
  Gene Name: cyclin-dependent kinase 4
  ENSP ID: ENSP00000448963
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMA

SEQ ID NO: 21309 - protein, 203 aa, Homo sapiens
  Payload ID: 4287
  Gene Symbol: CDK4
  Gene Name: cyclin-dependent kinase 4
  ENSP ID: ENSP00000449179
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCI

SEQ ID NO: 21310 - protein, 132 aa, Homo sapiens
  Payload ID: 4287
  Gene Symbol: CDK4
  Gene Name: cyclin-dependent kinase 4
  ENSP ID: ENSP00000449391
MDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAE

SEQ ID NO: 21311 - protein, 2 aa, Homo sapiens
  Payload ID: 4287
  Gene Symbol: CDK4
  Gene Name: cyclin-dependent kinase 4
  ENSP ID: ENSP00000449725
MA

SEQ ID NO: 21312 - protein, 260 aa, Homo sapiens
  Payload ID: 4288
  Gene Symbol: CDK5
  Gene Name: cyclin-dependent kinase 5
  Uniprot ID: Q00535
  ENSP ID: ENSP00000297518
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 21313 - protein, 292 aa, Homo sapiens
  Payload ID: 4288
  Gene Symbol: CDK5
  Gene Name: cyclin-dependent kinase 5
  Uniprot ID: Q00535
  ENSP ID: ENSP00000419782
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 21314 - protein, 307 aa, Homo sapiens
  Payload ID: 4289
  Gene Symbol: CDK5R1
  Gene Name: cyclin-dependent kinase 5, regulatory subunit 1 (p35)
  Uniprot ID: Q15078
  ENSP ID: ENSP00000318486
MGTVLSLSPSYRKATLFEDGAATVGHYTAVQNSKNAKDKNLKRHSIISVLPWKRIVAVSAKKKNSKKVQPNSSYQNNITHLNNENLKKSLSCANLSTFAQPPPAQPPAPPASQLSGSQTGGSSSVKKAPHPAVTSAGTPKRVIVQASTSELLRCLGEFLCRRCYRLKHLSPTDPVLWLRSVDRSLLLQGWQDQGFITPANVVFLYMLCRDVISSEVGSDHELQAVLLTCLYLSYSYMGNEISYPLKPFLVESCKEAFWDRCLSVINLMSSKMLQINADPHYFTQVFSDLKNESGQEDKKRLLLGLDR

SEQ ID NO: 21315 - protein, 115 aa, Homo sapiens
  Payload ID: 4289
  Gene Symbol: CDK5R1
  Gene Name: cyclin-dependent kinase 5, regulatory subunit 1 (p35)
  ENSP ID: ENSP00000463654
  MOD_RES (1)..(1): Any amino acid
XAKKKNSKKVQPNSSYQNNITHLNNENLKKSLSCANLSTFAQPPPAQPPAPPASQLSGSQTGGSSSVKKAPHPAVTSAGTPKRVIVQASTSELLRCLGMLSPPRWARITSSRPSC

SEQ ID NO: 21316 - protein, 115 aa, Homo sapiens; identical to SEQ ID NO: 21315
  Payload ID: 4289
  Gene Symbol: CDK5R1
  Gene Name: cyclin-dependent kinase 5, regulatory subunit 1 (p35)
  ENSP ID: ENSP00000464129
  MOD_RES (1)..(1): Any amino acid

SEQ ID NO: 21317 - protein, 367 aa, Homo sapiens
  Payload ID: 4290
  Gene Symbol: CDK5R2
  Gene Name: cyclin-dependent kinase 5, regulatory subunit 2 (p39)
  Uniprot ID: Q13319
  ENSP ID: ENSP00000304250
MGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 21318 - protein, 326 aa, Homo sapiens
  Payload ID: 4291
  Gene Symbol: CDK6
  Gene Name: cyclin-dependent kinase 6
  Uniprot ID: Q00534
  ENSP ID: ENSP00000265734
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 21319 - protein, 326 aa, Homo sapiens; identical to SEQ ID NO: 21318
  Payload ID: 4291
  Gene Symbol: CDK6
  Gene Name: cyclin-dependent kinase 6
  Uniprot ID: Q00534
  ENSP ID: ENSP00000397087

SEQ ID NO: 21320 - protein, 346 aa, Homo sapiens
  Payload ID: 4292
  Gene Symbol: CDK7
  Gene Name: cyclin-dependent kinase 7
  Uniprot ID: P50613
  ENSP ID: ENSP00000256443
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 21321 - protein, 69 aa, Homo sapiens
  Payload ID: 4292
  Gene Symbol: CDK7
  Gene Name: cyclin-dependent kinase 7
  ENSP ID: ENSP00000421559
MALDVKSRAKRYEKLDFLGEGQFATVYKARDKNTNQIVAIKKIKLGHRSEAKDGGIGPPSYYLELGCMV

SEQ ID NO: 21322 - protein, 58 aa, Homo sapiens
  Payload ID: 4292
  Gene Symbol: CDK7
  Gene Name: cyclin-dependent kinase 7
  ENSP ID: ENSP00000422027
MALDVKSRAKRYEKLDFLGEGQFATVYKARDKNTNQIVAIKKESLLVATTAVNVLCHT

SEQ ID NO: 21323 - protein, 253 aa, Homo sapiens
  Payload ID: 4292
  Gene Symbol: CDK7
  Gene Name: cyclin-dependent kinase 7
  ENSP ID: ENSP00000422121
METDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 21324 - protein, 309 aa, Homo sapiens
  Payload ID: 4292
  Gene Symbol: CDK7
  Gene Name: cyclin-dependent kinase 7
  ENSP ID: ENSP00000422737
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 21325 - protein, 149 aa, Homo sapiens
  Payload ID: 4292
  Gene Symbol: CDK7
  Gene Name: cyclin-dependent kinase 7
  ENSP ID: ENSP00000425043
METDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCS

SEQ ID NO: 21326 - protein, 77 aa, Homo sapiens
  Payload ID: 4292
  Gene Symbol: CDK7
  Gene Name: cyclin-dependent kinase 7
  ENSP ID: ENSP00000425893
MALDVKSRAKRYEKLDFLGEGQFATVYKARDKNTNQIVAIKKIKLGHRSEAKDGINRTALREIKLLQELSHPNIIAP

SEQ ID NO: 21327 - protein, 58 aa, Homo sapiens
  Payload ID: 4292
  Gene Symbol: CDK7
  Gene Name: cyclin-dependent kinase 7
  ENSP ID: ENSP00000425983
MALDVKSRAKRYEKLDFLGEGQFATVYKARDKNTNQIVAIKKIKLGHRSEAKDGYNKG

SEQ ID NO: 21328 - protein, 55 aa, Homo sapiens
  Payload ID: 4292
  Gene Symbol: CDK7
  Gene Name: cyclin-dependent kinase 7
  ENSP ID: ENSP00000426372
MALDVKSRAKRYEKLDFLGEGQFATVYKARDKNTNQIVAIKKIKLGHRSEAKDAP

SEQ ID NO: 21329 - protein, 43 aa, Homo sapiens
  Payload ID: 4292
  Gene Symbol: CDK7
  Gene Name: cyclin-dependent kinase 7
  ENSP ID: ENSP00000426561
MALDVKSRAKRYEKLDFLGEGQFATVYKARDKNTNQIVAIKKV

SEQ ID NO: 21330 - protein, 58 aa, Homo sapiens; identical to SEQ ID NO: 21327
  Payload ID: 4292
  Gene Symbol: CDK7
  Gene Name: cyclin-dependent kinase 7
  ENSP ID: ENSP00000477752

SEQ ID NO: 21331 - protein, 77 aa, Homo sapiens; identical to SEQ ID NO: 21326
  Payload ID: 4292
  Gene Symbol: CDK7
  Gene Name: cyclin-dependent kinase 7
  ENSP ID: ENSP00000477833

SEQ ID NO: 21332 - protein, 149 aa, Homo sapiens; identical to SEQ ID NO: 21325
  Payload ID: 4292
  Gene Symbol: CDK7
  Gene Name: cyclin-dependent kinase 7
  ENSP ID: ENSP00000477911

SEQ ID NO: 21333 - protein, 69 aa, Homo sapiens; identical to SEQ ID NO: 21321
  Payload ID: 4292
  Gene Symbol: CDK7
  Gene Name: cyclin-dependent kinase 7
  ENSP ID: ENSP00000478296

SEQ ID NO: 21334 - protein, 253 aa, Homo sapiens; identical to SEQ ID NO: 21323
  Payload ID: 4292
  Gene Symbol: CDK7
  Gene Name: cyclin-dependent kinase 7
  ENSP ID: ENSP00000478687

SEQ ID NO: 21335 - protein, 55 aa, Homo sapiens; identical to SEQ ID NO: 21328
  Payload ID: 4292
  Gene Symbol: CDK7
  Gene Name: cyclin-dependent kinase 7
  ENSP ID: ENSP00000478968

SEQ ID NO: 21336 - protein, 346 aa, Homo sapiens; identical to SEQ ID NO: 21320
  Payload ID: 4292
  Gene Symbol: CDK7
  Gene Name: cyclin-dependent kinase 7
  Uniprot ID: P50613
  ENSP ID: ENSP00000479116

SEQ ID NO: 21337 - protein, 43 aa, Homo sapiens; identical to SEQ ID NO: 21329
  Payload ID: 4292
  Gene Symbol: CDK7
  Gene Name: cyclin-dependent kinase 7
  ENSP ID: ENSP00000479440

SEQ ID NO: 21338 - protein, 58 aa, Homo sapiens; identical to SEQ ID NO: 21322
  Payload ID: 4292
  Gene Symbol: CDK7
  Gene Name: cyclin-dependent kinase 7
  ENSP ID: ENSP00000483013

SEQ ID NO: 21339 - protein, 309 aa, Homo sapiens; identical to SEQ ID NO: 21324
  Payload ID: 4292
  Gene Symbol: CDK7
  Gene Name: cyclin-dependent kinase 7
  ENSP ID: ENSP00000483754

SEQ ID NO: 21340 - protein, 58 aa, Homo sapiens; identical to SEQ ID NO: 21322
  Payload ID: 4292
  Gene Symbol: CDK7
  Gene Name: cyclin-dependent kinase 7
  ENSP ID: ENSP00000485943

SEQ ID NO: 21341 - protein, 58 aa, Homo sapiens; identical to SEQ ID NO: 21322
  Payload ID: 4292
  Gene Symbol: CDK7
  Gene Name: cyclin-dependent kinase 7
  ENSP ID: ENSP00000486415

SEQ ID NO: 21342 - protein, 69 aa, Homo sapiens; identical to SEQ ID NO: 21321
  Payload ID: 4292
  Gene Symbol: CDK7
  Gene Name: cyclin-dependent kinase 7
  ENSP ID: ENSP00000486424

SEQ ID NO: 21343 - protein, 69 aa, Homo sapiens; identical to SEQ ID NO: 21321
  Payload ID: 4292
  Gene Symbol: CDK7
  Gene Name: cyclin-dependent kinase 7
  ENSP ID: ENSP00000486479

SEQ ID NO: 21344 - protein, 77 aa, Homo sapiens
  Payload ID: 4292
  Gene Symbol: CDK7
  Gene Name: cyclin-dependent kinase 7
  ENSP ID: ENSP00000486950
MALDVKSRAKRYEKLDFLGEGQFATVYKARDKNTNQIVAIKKIKLGHRSEAKDGINRTALREIKLLQELSHPNIIGP

SEQ ID NO: 21345 - protein, 77 aa, Homo sapiens; identical to SEQ ID NO: 21344
  Payload ID: 4292
  Gene Symbol: CDK7
  Gene Name: cyclin-dependent kinase 7
  ENSP ID: ENSP00000487392

SEQ ID NO: 21346 - protein, 464 aa, Homo sapiens
  Payload ID: 4293
  Gene Symbol: CDK8
  Gene Name: cyclin-dependent kinase 8
  Uniprot ID: P49336
  ENSP ID: ENSP00000370938
MDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPYHHDQLDRIFNVMGFPADKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKKNQQQQQGNNHTNGTGHPGNQDSSHTQGPPLKKVRVVPPTTTSGGLIMTSDYQRSNPHAAYPNPGPSTSQPQSSMGYSATSQQPPQYSHQTHRY

SEQ ID NO: 21347 - protein, 164 aa, Homo sapiens
  Payload ID: 4293
  Gene Symbol: CDK8
  Gene Name: cyclin-dependent kinase 8
  ENSP ID: ENSP00000437696
MDYDFKVKLSSERERVEDLFEYEGCKVGRGTYGHVYKAKRKDGKDDKDYALKQIEGTGISMSACREIALLRELKHPNVISLQKVFLSHADRKVWLLFDYAEHDLWHIIKFHRASKANKKPVQLPRGMVKSLLYQILDGIHYLHANWVLHRDLLTWALPDYLIHL

SEQ ID NO: 21348 - protein, 148 aa, Homo sapiens
  Payload ID: 4293
  Gene Symbol: CDK8
  Gene Name: cyclin-dependent kinase 8
  ENSP ID: ENSP00000485883
  MOD_RES (1)..(1): Any amino acid
XKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKRSNPHAAYPNPGPSTSQPQSSMGYSATSQQPPQYSHQTHRY

SEQ ID NO: 21349 - protein, 195 aa, Homo sapiens
  Payload ID: 4293
  Gene Symbol: CDK8
  Gene Name: cyclin-dependent kinase 8
  ENSP ID: ENSP00000487013
  MOD_RES (1)..(1): Any amino acid
XDMGFARLFNSPLKPLADLDPVVVTFWYRAPELLLGARHYTKAIDKDWEDIKKMPEHSTLMKDFRRNTYTNCSLIKYMEKHKVKPDSKAFHLLQKLLTMDPIKRITSEQAMQDPYFLEDPLPTSDVFAGCQIPYPKREFLTEEEPDDKGDKKNQQQQQGNNHTNGTGHPGNQDSSHTQGPPLKKVRVVPPTTTSG

SEQ ID NO: 21350 - protein, 372 aa, Homo sapiens
  Payload ID: 4294
  Gene Symbol: CDK9
  Gene Name: cyclin-dependent kinase 9
  Uniprot ID: P50750
  ENSP ID: ENSP00000362361
MAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQGNTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 21351 - protein, 194 aa, Homo sapiens
  Payload ID: 4294
  Gene Symbol: CDK9
  Gene Name: cyclin-dependent kinase 9
  ENSP ID: ENSP00000395872
MQRDAPPRAPAPAPRLPAPPIGAAASSGGGGGGGSGGGGGGASAAPAPPGLSGTTSPRGPGGGRRAEEAGSAPRGRKWPWRRKWRGRGGAWSAAAAGPGAGAAAAATGGGGGALEAAMAKQYDSVECPFCDEVSKYEKLAKIGQGTFGEVFKARHRKTGQKVALKKVLMENEKEGFPITALREIKILQLLKHEN

SEQ ID NO: 21352 - protein, 164 aa, Homo sapiens
  Payload ID: 4295
  Gene Symbol: CDKN1A
  Gene Name: cyclin-dependent kinase inhibitor 1A (p21, Cip1)
  Uniprot ID: P38936
  ENSP ID: ENSP00000244741
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 21353 - protein, 164 aa, Homo sapiens; identical to SEQ ID NO: 21352
  Payload ID: 4295
  Gene Symbol: CDKN1A
  Gene Name: cyclin-dependent kinase inhibitor 1A (p21, Cip1)
  Uniprot ID: P38936
  ENSP ID: ENSP00000362815

SEQ ID NO: 21354 - protein, 164 aa, Homo sapiens; identical to SEQ ID NO: 21352
  Payload ID: 4295
  Gene Symbol: CDKN1A
  Gene Name: cyclin-dependent kinase inhibitor 1A (p21, Cip1)
  Uniprot ID: P38936
  ENSP ID: ENSP00000384849

SEQ ID NO: 21355 - protein, 164 aa, Homo sapiens; identical to SEQ ID NO: 21352
  Payload ID: 4295
  Gene Symbol: CDKN1A
  Gene Name: cyclin-dependent kinase inhibitor 1A (p21, Cip1)
  Uniprot ID: P38936
  ENSP ID: ENSP00000409259

SEQ ID NO: 21356 - protein, 164 aa, Homo sapiens; identical to SEQ ID NO: 21352
  Payload ID: 4295
  Gene Symbol: CDKN1A
  Gene Name: cyclin-dependent kinase inhibitor 1A (p21, Cip1)
  Uniprot ID: P38936
  ENSP ID: ENSP00000482768

SEQ ID NO: 21357 - protein, 198 aa, Homo sapiens
  Payload ID: 4296
  Gene Symbol: CDKN1B
  Gene Name: cyclin-dependent kinase inhibitor 1B (p27, Kip1)
  Uniprot ID: P46527
  ENSP ID: ENSP00000228872
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 21358 - protein, 205 aa, Homo sapiens
  Payload ID: 4296
  Gene Symbol: CDKN1B
  Gene Name: cyclin-dependent kinase inhibitor 1B (p27, Kip1)
  ENSP ID: ENSP00000379629
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDTSLLDEARKIYMKILKIHIADFMEWTSCISTEKQQHNNTKILGTLK

SEQ ID NO: 21359 - protein, 104 aa, Homo sapiens
  Payload ID: 4296
  Gene Symbol: CDKN1B
  Gene Name: cyclin-dependent kinase inhibitor 1B (p27, Kip1)
  ENSP ID: ENSP00000407597
NGSPSLERMDARQAEHPKPSACRNLFGPVDHEELTRDLEKHCRDMEEASQRKWNFDFQNHKPLEDSSTQNKRANRTEENVSDGSPNAGSVEQTPKKPGLRRRQT

SEQ ID NO: 21360 - protein, 305 aa, Homo sapiens
  Payload ID: 4297
  Gene Symbol: CDKN1C
  Gene Name: cyclin-dependent kinase inhibitor 1C (p57, Kip2)
  ENSP ID: ENSP00000321019
MERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAARAPAPARARAPAPAPAPAPDAAPQESAEQGANQGQRGQEPLADQLHSGISGRPAAGTAAASANGAAIKKLSGPLISDFFAKRKRSAPEKSSGDVPAPCPSPSAAPGVGSVEQTPRKRLR

SEQ ID NO: 21361 - protein, 131 aa, Homo sapiens
  Payload ID: 4297
  Gene Symbol: CDKN1C
  Gene Name: cyclin-dependent kinase inhibitor 1C (p57, Kip2)
  ENSP ID: ENSP00000370101
MERLVARGTFPVLVRTSACRSLFGPVDHEELSRELQARLAELNAEDQNRWDYDFQQDMPLRGPGRLQWTEVDSDSVPAFYRETVQISSPSARDQRLRSRRAMSPRRVPLQAPPLAWARWSRPRARGCGEPI

SEQ ID NO: 21362 - protein, 305 aa, Homo sapiens
  Payload ID: 4297
  Gene Symbol: CDKN1C
  Gene Name: cyclin-dependent kinase inhibitor 1C (p57, Kip2)
  Uniprot ID: P49918
  ENSP ID: ENSP00000411257
MERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAAPAPAPAPAPAPAPAPAPAPDAAPQESAEQGANQGQRGQEPLADQLHSGISGRPAAGTAAASANGAAIKKLSGPLISDFFAKRKRSAPEKSSGDVPAPCPSPSAAPGVGSVEQTPRKRLR

SEQ ID NO: 21363 - protein, 316 aa, Homo sapiens
  Payload ID: 4297
  Gene Symbol: CDKN1C
  Gene Name: cyclin-dependent kinase inhibitor 1C (p57, Kip2)
  Uniprot ID: P49918
  ENSP ID: ENSP00000411552
MSDASLRSTSTMERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAAPAPAPAPAPAPAPAPAPAPDAAPQESAEQGANQGQRGQEPLADQLHSGISGRPAAGTAAASANGAAIKKLSGPLISDFFAKRKRSAPEKSSGDVPAPCPSPSAAPGVGSVEQTPRKRLR

SEQ ID NO: 21364 - protein, 316 aa, Homo sapiens; identical to SEQ ID NO: 21363
  Payload ID: 4297
  Gene Symbol: CDKN1C
  Gene Name: cyclin-dependent kinase inhibitor 1C (p57, Kip2)
  Uniprot ID: P49918
  ENSP ID: ENSP00000413720

SEQ ID NO: 21365 - protein, 316 aa, Homo sapiens
  Payload ID: 4297
  Gene Symbol: CDKN1C
  Gene Name: cyclin-dependent kinase inhibitor 1C (p57, Kip2)
  ENSP ID: ENSP00000484462
MSDASLRSTSTMERLVARGTFPVLVRTSACRSLFGPVDHEELSRELQARLAELNAEDQNRWDYDFQQDMPLRGPGRLQWTEVDSDSVPAFYRETVQVGRCRLLLAPRPVAVAVAVSPPLEPAAESLDGLEEAPEQLPSVPVPAPASTPPPVPVLAPAPAPAPAPVAAPVAAPVAVAVLAPAPAPAPAPAPAPAPVAARAPAPARARAPAPAPAPAPDAAPQESAEQGANQGQRGQEPLADQLHSGISGRPAAGTAAASANGAAIKKLSGPLISDFFAKRKRSAPEKSSGDVPAPCPSPSAAPGVGSVEQTPRKRLR

SEQ ID NO: 21366 - protein, 131 aa, Homo sapiens; identical to SEQ ID NO: 21361
  Payload ID: 4297
  Gene Symbol: CDKN1C
  Gene Name: cyclin-dependent kinase inhibitor 1C (p57, Kip2)
  ENSP ID: ENSP00000488761

SEQ ID NO: 21367 - protein, 316 aa, Homo sapiens; identical to SEQ ID NO: 21365
  Payload ID: 4297
  Gene Symbol: CDKN1C
  Gene Name: cyclin-dependent kinase inhibitor 1C (p57, Kip2)
  ENSP ID: ENSP00000488786

SEQ ID NO: 21368 - protein, 156 aa, Homo sapiens
  Payload ID: 4298
  Gene Symbol: CDKN2A
  Gene Name: cyclin-dependent kinase inhibitor 2A
  Uniprot ID: P42771
  ENSP ID: ENSP00000307101
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 21369 - protein, 170 aa, Homo sapiens
  Payload ID: 4298
  Gene Symbol: CDKN2A
  Gene Name: cyclin-dependent kinase inhibitor 2A
  ENSP ID: ENSP00000355153
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTVHDAAREGFLDTLVVLHRAGARLDVRDAWGRLPVDLAEELGHRDVARYLRAAAGGTRGSNHARIDAAEGPSDIPD

SEQ ID NO: 21370 - protein, 116 aa, Homo sapiens
  Payload ID: 4298
  Gene Symbol: CDKN2A
  Gene Name: cyclin-dependent kinase inhibitor 2A
  ENSP ID: ENSP00000369496
MEPAAGSSMEPSADWLATAAARGRVEEVRALLEAGALPNAPNSYGRRPIQVGRGSAAGAGDGGRLWRTKFAGELESGSASILRKKGRLPGEFSEGVCNHRPPPGDALGAWEAKEEE

SEQ ID NO: 21371 - protein, 167 aa, Homo sapiens
  Payload ID: 4298
  Gene Symbol: CDKN2A
  Gene Name: cyclin-dependent kinase inhibitor 2A
  Uniprot ID: P42771
  ENSP ID: ENSP00000418915
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSEMIGNHLWVCRSRHA

SEQ ID NO: 21372 - protein, 132 aa, Homo sapiens
  Payload ID: 4298
  Gene Symbol: CDKN2A
  Gene Name: cyclin-dependent kinase inhibitor 2A
  Uniprot ID: Q8N726
  ENSP ID: ENSP00000432664
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 21373 - protein, 132 aa, Homo sapiens; identical to SEQ ID NO: 21372
  Payload ID: 4298
  Gene Symbol: CDKN2A
  Gene Name: cyclin-dependent kinase inhibitor 2A
  Uniprot ID: Q8N726
  ENSP ID: ENSP00000462950

SEQ ID NO: 21374 - protein, 138 aa, Homo sapiens
  Payload ID: 4298
  Gene Symbol: CDKN2A
  Gene Name: cyclin-dependent kinase inhibitor 2A
  ENSP ID: ENSP00000464202
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARHPRLKEPERL

SEQ ID NO: 21375 - protein, 105 aa, Homo sapiens
  Payload ID: 4298
  Gene Symbol: CDKN2A
  Gene Name: cyclin-dependent kinase inhibitor 2A
  Uniprot ID: P42771
  ENSP ID: ENSP00000464952
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 21376 - protein, 121 aa, Homo sapiens
  Payload ID: 4298
  Gene Symbol: CDKN2A
  Gene Name: cyclin-dependent kinase inhibitor 2A
  ENSP ID: ENSP00000466887
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSVTASIQVPGGEEGDFGSSYS

SEQ ID NO: 21377 - protein, 105 aa, Homo sapiens; identical to SEQ ID NO: 21375
  Payload ID: 4298
  Gene Symbol: CDKN2A
  Gene Name: cyclin-dependent kinase inhibitor 2A
  Uniprot ID: P42771
  ENSP ID: ENSP00000467390

SEQ ID NO: 21378 - protein, 105 aa, Homo sapiens; identical to SEQ ID NO: 21375
  Payload ID: 4298
  Gene Symbol: CDKN2A
  Gene Name: cyclin-dependent kinase inhibitor 2A
  Uniprot ID: P42771
  ENSP ID: ENSP00000467857

SEQ ID NO: 21379 - protein, 104 aa, Homo sapiens
  Payload ID: 4298
  Gene Symbol: CDKN2A
  Gene Name: cyclin-dependent kinase inhibitor 2A
  ENSP ID: ENSP00000468510
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSGED

SEQ ID NO: 21380 - protein, 138 aa, Homo sapiens
  Payload ID: 4299
  Gene Symbol: CDKN2B
  Gene Name: cyclin-dependent kinase inhibitor 2B (p15, inhibits CDK4)
  Uniprot ID: P42772
  ENSP ID: ENSP00000276925
MREENKGMPSGGGSDEGLASAAARGLVEKVRQLLEAGADPNGVNRFGRRAIQVMMMGSARVAELLLLHGAEPNCADPATLTRPVHDAAREGFLDTLVVLHRAGARLDVRDAWGRLPVDLAEERGHRDVAGYLRTATGD

SEQ ID NO: 21381 - protein, 78 aa, Homo sapiens
  Payload ID: 4299
  Gene Symbol: CDKN2B
  Gene Name: cyclin-dependent kinase inhibitor 2B (p15, inhibits CDK4)
  Uniprot ID: P42772
  ENSP ID: ENSP00000369487
MREENKGMPSGGGSDEGLASAAARGLVEKVRQLLEAGADPNGVNRFGRRAIQVAGAPGPRRQGARERGARPRRIGAGT

SEQ ID NO: 21382 - protein, 168 aa, Homo sapiens
  Payload ID: 4300
  Gene Symbol: CDKN2C
  Gene Name: cyclin-dependent kinase inhibitor 2C (p18, inhibits CDK4)
  Uniprot ID: P42773
  ENSP ID: ENSP00000262662
MAEPWGNELASAAARGDLEQLTSLLQNNVNVNAQNGFGRTALQVMKLGNPEIARRLLLRGANPDLKDRTGFAVIHDAARAGFLDTLQTLLEFQADVNIEDNEGNLPLHLAAKEGHLRVVEFLVKHTASNVGHRNHKGDTACDLARLYGRNEVVSLMQANGAGGATNLQ

SEQ ID NO: 21383 - protein, 168 aa, Homo sapiens; identical to SEQ ID NO: 21382
  Payload ID: 4300
  Gene Symbol: CDKN2C
  Gene Name: cyclin-dependent kinase inhibitor 2C (p18, inhibits CDK4)
  Uniprot ID: P42773
  ENSP ID: ENSP00000360826

SEQ ID NO: 21384 - protein, 168 aa, Homo sapiens; identical to SEQ ID NO: 21382
  Payload ID: 4300
  Gene Symbol: CDKN2C
  Gene Name: cyclin-dependent kinase inhibitor 2C (p18, inhibits CDK4)
  Uniprot ID: P42773
  ENSP ID: ENSP00000379452

SEQ ID NO: 21385 - protein, 166 aa, Homo sapiens
  Payload ID: 4301
  Gene Symbol: CDKN2D
  Gene Name: cyclin-dependent kinase inhibitor 2D (p19, inhibits CDK4)
  Uniprot ID: P55273
  ENSP ID: ENSP00000337056
MLLEEVRAGDRLSGAAARGDVQEVRRLLHRELVHPDALNRFGKTALQVMMFGSTAIALELLKQGASPNVQDTSGTSPVHDAARTGFLDTLKVLVEHGADVNVPDGTGALPIHLAVQEGHTAVVSFLAAESDLHRRDARGLTPLELALQRGAQDLVDILQGHMVAPL

SEQ ID NO: 21386 - protein, 166 aa, Homo sapiens; identical to SEQ ID NO: 21385
  Payload ID: 4301
  Gene Symbol: CDKN2D
  Gene Name: cyclin-dependent kinase inhibitor 2D (p19, inhibits CDK4)
  Uniprot ID: P55273
  ENSP ID: ENSP00000377224

SEQ ID NO: 21387 - protein, 212 aa, Homo sapiens
  Payload ID: 4302
  Gene Symbol: CDKN3
  Gene Name: cyclin-dependent kinase inhibitor 3
  Uniprot ID: Q16667
  ENSP ID: ENSP00000335357
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 21388 - protein, 166 aa, Homo sapiens
  Payload ID: 4302
  Gene Symbol: CDKN3
  Gene Name: cyclin-dependent kinase inhibitor 3
  ENSP ID: ENSP00000378944
MNPCCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 21389 - protein, 211 aa, Homo sapiens
  Payload ID: 4302
  Gene Symbol: CDKN3
  Gene Name: cyclin-dependent kinase inhibitor 3
  ENSP ID: ENSP00000396451
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLAACLLLYLSDTISPEQAIDSLRDLRGSGAIQTIKQYNYLHEFRDKLAAHLSSRDSQSRSVSR

SEQ ID NO: 21390 - protein, 172 aa, Homo sapiens
  Payload ID: 4302
  Gene Symbol: CDKN3
  Gene Name: cyclin-dependent kinase inhibitor 3
  Uniprot ID: Q16667
  ENSP ID: ENSP00000415333
MKPPSSIQTSCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKQYNYLHEFRDKLAAHLSSRDSQSRSVSR

SEQ ID NO: 21391 - protein, 148 aa, Homo sapiens
  Payload ID: 4302
  Gene Symbol: CDKN3
  Gene Name: cyclin-dependent kinase inhibitor 3
  ENSP ID: ENSP00000440404
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHSCLSPTIPV

SEQ ID NO: 21392 - protein, 146 aa, Homo sapiens
  Payload ID: 4302
  Gene Symbol: CDKN3
  Gene Name: cyclin-dependent kinase inhibitor 3
  ENSP ID: ENSP00000445572
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIQAFEGVLR

SEQ ID NO: 21393 - protein, 203 aa, Homo sapiens
  Payload ID: 4302
  Gene Symbol: CDKN3
  Gene Name: cyclin-dependent kinase inhibitor 3
  ENSP ID: ENSP00000450711
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTPDIASCCEIMEELTTCLKNYRKTLIHCYGGLGRSCLVAACLLLYLSDTISPEQAIDSLRDLRGSGAIQTIKDLPTSQFLPQSVLGMDPLT

SEQ ID NO: 21394 - protein, 35 aa, Homo sapiens
  Payload ID: 4302
  Gene Symbol: CDKN3
  Gene Name: cyclin-dependent kinase inhibitor 3
  ENSP ID: ENSP00000479875
LKPSSIQTSEFDSSDEEPIEDEQTPIHISWLSLTN

SEQ ID NO: 21395 - protein, 207 aa, Homo sapiens [sequence omitted]

SEQ ID NO: 21396 - protein, 276 aa, Homo sapiens
  Payload ID: 4303
  Gene Symbol: CDKL1
  Gene Name: cyclin-dependent kinase-like 1 (CDC2-related kinase)
  ENSP ID: ENSP00000216378
MMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGRVPIASRTE

SEQ ID NO: 21397 - protein, 358 aa, Homo sapiens
  Payload ID: 4303
  Gene Symbol: CDKL1
  Gene Name: cyclin-dependent kinase-like 1 (CDC2-related kinase)
  Uniprot ID: Q00532
  ENSP ID: ENSP00000379176
MMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGCLHMDPTQRLTCEQLLHHPYFENIREIEDLAKEHNKPTRKTLRKSRKHHCFTETSKLQYLPQLTGSSILPALDNKKYYCDTKKLNYRFPNI

SEQ ID NO: 21398 - protein, 70 aa, Homo sapiens
  Payload ID: 4303
  Gene Symbol: CDKL1
  Gene Name: cyclin-dependent kinase-like 1 (CDC2-related kinase)
  ENSP ID: ENSP00000431449
  MOD_RES (1)..(1): Any amino acid
XDLIPRHQQVFSTNQYFSGVKIPDPEDMEPLELKFPNISYPALGLLKLQYLPQLTGSSILPALDNKKYYC

SEQ ID NO: 21399 - protein, 140 aa, Homo sapiens
  Payload ID: 4303
  Gene Symbol: CDKL1
  Gene Name: cyclin-dependent kinase-like 1 (CDC2-related kinase)
  ENSP ID: ENSP00000435044
  MOD_RES (1)..(1): Any amino acid
XAIGCVFAELLSGVPLWPGKSDVDQLYLIRKTLGDLIPRHQQVFSTNQYFSGVKIPDPEDMEPLELKFPNISYPALGLLKGCLHMDPTQRLTCEQLLHHPYFENIREIEDLAKEHNKPTRKTLRKSRKHHCFTETSKVII

SEQ ID NO: 21400 - protein, 570 aa, Homo sapiens
  Payload ID: 4304
  Gene Symbol: CDKL2
  Gene Name: cyclin-dependent kinase-like 2 (CDC2-related kinase)
  ENSP ID: ENSP00000306340
MEKYENLGLVGEGSYGMVMKCRNKDTGRIVAIKKFLESDDDKMVKKIAMREIKLLKQLRHENLVNLLEVCKKKKRWYLVFEFVDHTILDDLELFPNGLDYQVVQKYLFQIINGIGFCHSHNIIHRDIKPENILVSQSGVVKLCDFGFARTLAAPGEVYTDYVATRWYRAPELLVGDVKYGKAVDVWAIGCLVTEMFMGEPLFPGDSDIDQLYHIMMCLGNLIPRHQELFNKNPVFAGVRLPEIKEREPLERRYPKLSEVVIDLAKKCLHIDPDKRPFCAELLHHDFFQMDGFAERFSQELQLKVQKDARNVSLSKKSQNRKKEKEKDDSLVEERKTLVVQDTNADPKIKDYKLFKIKGSKIDGEKAEKGNRASNASCLHDSRTSHNKIVPSTSLKDCSNVSVDHTRNPSVAIPPLTHNLSAVAPSINSGMGTETIPIQGYRVDEKTKKCSIPFVKPNRHSPSGIYNINVTTLVSSEKNLFWASKKRREYSRTDVRLPELNYNHLPELRALGGIARNSRLTKKESKILSESRIPSLAAIDLHTPSITLHQVSGPPLSDDSGADLPQMEHQH

SEQ ID NO: 21401 - protein, 493 aa, Homo sapiens
  Payload ID: 4304
  Gene Symbol: CDKL2
  Gene Name: cyclin-dependent kinase-like 2 (CDC2-related kinase)
  Uniprot ID: Q92772
  ENSP ID: ENSP00000412365
MEKYENLGLVGEGSYGMVMKCRNKDTGRIVAIKKFLESDDDKMVKKIAMREIKLLKQLRHENLVNLLEVCKKKKRWYLVFEFVDHTILDDLELFPNGLDYQVVQKYLFQIINGIGFCHSHNIIHRDIKPENILVSQSGVVKLCDFGFARTLAAPGEVYTDYVATRWYRAPELLVGDVKYGKAVDVWAIGCLVTEMFMGEPLFPGDSDIDQLYHIMMCLGNLIPRHQELFNKNPVFAGVRLPEIKEREPLERRYPKLSEVVIDLAKKCLHIDPDKRPFCAELLHHDFFQMDGFAERFSQELQLKVQKDARNVSLSKKSQNRKKEKEKDDSLVEERKTLVVQDTNADPKIKDYKLFKIKGSKIDGEKAEKGNRASNASCLHDSRTSHNKIVPSTSLKDCSNVSVDHTRNPSVAIPPLTHNLSAVAPSINSGMGTETIPIQGYRVDEKTKKCSIPFVKPNRHSPSGIYNINVTTLVSGPPLSDDSGADLPQMEHQH

SEQ ID NO: 21402 - protein, 58 aa, Homo sapiens
  Payload ID: 4304
  Gene Symbol: CDKL2
  Gene Name: cyclin-dependent kinase-like 2 (CDC2-related kinase)
  ENSP ID: ENSP00000422666
MEKYENLGLVGEGSYGMVMKCRNKDTGRIVAIKKFLESDDDKMVKKIAMREIKLLKVI

SEQ ID NO: 21403 - protein, 592 aa, Homo sapiens
  Payload ID: 4305
  Gene Symbol: CDKL3
  Gene Name: cyclin-dependent kinase-like 3
  Uniprot ID: Q8IVW4
  ENSP ID: ENSP00000265334
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQEGGDGHCEGKNLKRNRFFFW

SEQ ID NO: 21404 - protein, 106 aa, Homo sapiens
  Payload ID: 4305
  Gene Symbol: CDKL3
  Gene Name: cyclin-dependent kinase-like 3
  ENSP ID: ENSP00000427738
MIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKK

SEQ ID NO: 21405 - protein, 73 aa, Homo sapiens
  Payload ID: 4305
  Gene Symbol: CDKL3
  Gene Name: cyclin-dependent kinase-like 3
  ENSP ID: ENSP00000427836
  MOD_RES (1)..(1): Any amino acid
XTKGMEVKQIKMLKRESKKTESSKIPTLLNVDQNQEKQEFIPLSLLSACCPIFTNICSQLTIRVEMAIARGRI

SEQ ID NO: 21406 - protein, 44 aa, Homo sapiens
  Payload ID: 4305
  Gene Symbol: CDKL3
  Gene Name: cyclin-dependent kinase-like 3
  ENSP ID: ENSP00000427964
MIIEMATGNPYLPSSSDLDLLHKIVLKVGNRKREKAQGDQSQSY

SEQ ID NO: 21407 - protein, 18 aa, Homo sapiens
  Payload ID: 4305
  Gene Symbol: CDKL3
  Gene Name: cyclin-dependent kinase-like 3
  ENSP ID: ENSP00000428498
  MOD_RES (1)..(1): Any amino acid
XLNGLLADIVHIHARTES

SEQ ID NO: 21408 - protein, 401 aa, Homo sapiens
  Payload ID: 4305
  Gene Symbol: CDKL3
  Gene Name: cyclin-dependent kinase-like 3
  ENSP ID: ENSP00000428500
MIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQENTGNAQTERKKNLPDVE

SEQ ID NO: 21409 - protein, 590 aa, Homo sapiens
  Payload ID: 4305
  Gene Symbol: CDKL3
  Gene Name: cyclin-dependent kinase-like 3
  ENSP ID: ENSP00000428689
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVRLTERAKKRRTSSQSIGQVMPNSRQEDPGPIQSQMEKGIFNERTGHSDQMANENKRKLNFSRSDRKEFHFPELPVTIQSKDTKGMEVKQIKMLKRESKKTESSKIPTLLNVDQNQEKQENTGNAQTERKKNLPDVE

SEQ ID NO: 21410 - protein, 455 aa, Homo sapiens
  Payload ID: 4305
  Gene Symbol: CDKL3
  Gene Name: cyclin-dependent kinase-like 3
  Uniprot ID: Q8IVW4
  ENSP ID: ENSP00000430496
MEMYETLGKVGEGSYGTVMKCKHKNTGQIVAIKIFYERPEQSVNKIAMREIKFLKQFHHENLVNLIEVFRQKKKIHLVFEFIDHTVLDELQHYCHGLESKRLRKYLFQILRAIDYLHSNNIIHRDIKPENILVSQSGITKLCDFGFARTLAAPGDIYTDYVATRWYRAPELVLKDTSYGKPVDIWALGCMIIEMATGNPYLPSSSDLDLLHKIVLKVGNLSPHLQNIFSKSPIFAGVVLPQVQHPKNARKKYPKLNGLLADIVHACLQIDPADRISSSDLLHHEYFTRDGFIEKFMPELKAKLLQEAKVNSLIKPKESSKENELRKDERKTVYTNTLLSSSVLGKEIEKEKKPKEIKVRVIKVKGGRGDISEPKKKEYEGGLGQQDANENVHPMSPDTKLVTIEPPNPINPSTNCNGLKENPHCGGSVTMPPINLTNSNLMAANLSSNLFHPSVR

SEQ ID NO: 21411 - protein, 82 aa, Homo sapiens
  Payload ID: 4305
  Gene Symbol: CDKL3
  Gene Name: cyclin-dependent kinase-like 3
  ENSP ID: ENSP00000430777
MIIEMATGNPYLPSSSDLDLLHKIVLKVGNLSPHLQNIFSKSPIFAGVVLPQVQHPKNARKKYPKLNGLLADIVHIHARTES

SEQ ID NO: 21412 - protein, 315 aa, Homo sapiens
  Payload ID: 4306
  Gene Symbol: CDKL4
  Gene Name: cyclin-dependent kinase-like 4
  Uniprot ID: Q5MAI5
  ENSP ID: ENSP00000368080
MEKYEKLAKTGEGSYGVVFKCRNKTSGQVVAVKKFVESEDDPVVKKIALREIRMLKQLKHPNLVNLIEVFRRKRKMHLVFEYCDHTLLNELERNPNGVADGVIKSVLWQTLQALNFCHIHNCIHRDIKPENILITKQGIIKICDFGFAQILIPGDAYTDYVATRWYRAPELLVGDTQYGSSVDIWAIGCVFAELLTGQPLWPGKSDVDQLYLIIRTLGKLIPRHQSIFKSNGFFHGISIPEPEDMETLEEKFSDVHPVALNFMKGCLKMNPDDRLTCSQLLESSYFDSFQEAQIKRKARNEGRNRRRQQVLPLKS

SEQ ID NO: 21413 - protein, 379 aa, Homo sapiens
  Payload ID: 4306
  Gene Symbol: CDKL4
  Gene Name: cyclin-dependent kinase-like 4
  Uniprot ID: Q5MAI5
  ENSP ID: ENSP00000378476
MEKYEKLAKTGEGSYGVVFKCRNKTSGQVVAVKKFVESEDDPVVKKIALREIRMLKQLKHPNLVNLIEVFRRKRKMHLVFEYCDHTLLNELERNPNGVADGVIKSVLWQTLQALNFCHIHNCIHRDIKPENILITKQGIIKICDFGFAQILIPGDAYTDYVATRWYRAPELLVGDTQYGSSVDIWAIGCVFAELLTGQPLWPGKSDVDQLYLIIRTLGKLIPRHQSIFKSNGFFHGISIPEPEDMETLEEKFSDVHPVALNFMKGCLKMNPDDRLTCSQLLESSYFDSFQEAQIKRKARNEGRNRRRQQQAPKSAFPRLFLKTKICQVQRNETQTSGNQILPNGPILQNSMVTVMTNINSAVYQVTVLHLLSENFEVKS

SEQ ID NO: 21414 - protein, 124 aa, Homo sapiens
  Payload ID: 4306
  Gene Symbol: CDKL4
  Gene Name: cyclin-dependent kinase-like 4
  ENSP ID: ENSP00000389833
KLIPRHQSIFKSNGFFHGISIPEPEDMETLEEKFSDVHPVALNFMKGCLKMNPDDRLTCSQLLESSYFDSFQEAQIKRKARNEGRNRRRQQNQLLPLIPGSHISPTPDGRKQVLQLKFDHLPNI

SEQ ID NO: 21415 - protein, 58 aa, Homo sapiens
  Payload ID: 4306
  Gene Symbol: CDKL4
  Gene Name: cyclin-dependent kinase-like 4
  ENSP ID: ENSP00000399213
MEKYEKLAKTGEGSYGVVFKCRNKTSGQVVAVKKFVESEDDPVVKKIALREIRMLKSC

SEQ ID NO: 21416 - protein, 1030 aa, Homo sapiens
  Payload ID: 4307
  Gene Symbol: CDKL5
  Gene Name: cyclin-dependent kinase-like 5
  Uniprot ID: O76039
  ENSP ID: ENSP00000369325
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPDGGCDGRRQRHHSGPQDRRFMLRTTEQQGEYFCCGDPKKPHTPCVPNRALHRPISSPAPYPVLQVRGTSMCPTLQVRGTDAFSCPTQQSGFSFFVRHVMREALIHRAQVNQAALLTYHENAALTGK

SEQ ID NO: 21417 - protein, 1030 aa, Homo sapiens; identical to SEQ ID NO: 21416
  Payload ID: 4307
  Gene Symbol: CDKL5
  Gene Name: cyclin-dependent kinase-like 5
  Uniprot ID: O76039
  ENSP ID: ENSP00000369332

SEQ ID NO: 21418 - protein, 784 aa, Homo sapiens
  Payload ID: 4307
  Gene Symbol: CDKL5
  Gene Name: cyclin-dependent kinase-like 5
  ENSP ID: ENSP00000485184
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMK

SEQ ID NO: 21419 - protein, 960 aa, Homo sapiens
  Payload ID: 4307
  Gene Symbol: CDKL5
  Gene Name: cyclin-dependent kinase-like 5
  Uniprot ID: O76039
  ENSP ID: ENSP00000485244
MKIPNIGNVMNKFEILGVVGEGAYGVVLKCRHKETHEIVAIKKFKDSEENEEVKETTLRELKMLRTLKQENIVELKEAFRRRGKLYLVFEYVEKNMLELLEEMPNGVPPEKVKSYIYQLIKAIHWCHKNDIVHRDIKPENLLISHNDVLKLCDFGFARNLSEGNNANYTEYVATRWYRSPELLLGAPYGKSVDMWSVGCILGELSDGQPLFPGESEIDQLFTIQKVLGPLPSEQMKLFYSNPRFHGLRFPAVNHPQSLERRYLGILNSVLLDLMKNLLKLDPADRYLTEQCLNHPTFQTQRLLDRSPSRSAKRKPYHVESSTLSNRNQAGKSTALQSHHRSNSKDIQNLSVGLPRADEGLPANESFLNGNLAGASLSPLHTKTYQASSQPGSTSKDLTNNNIPHLLSPKEAKSKTEFDFNIDPKPSEGPGTKYLKSNSRSQQNRHSFMESSQSKAGTLQPNEKQSRHSYIDTIPQSSRSPSYRTKAKSHGALSDSKSVSNLSEARAQIAEPSTSRYFPSSCLDLNSPTSPTPTRHSDTRTLLSPSGRNNRNEGTLDSRRTTTRHSKTMEELKLPEHMDSSHSHSLSAPHESFSYGLGYTSPFSSQQRPHRHSMYVTRDKVRAKGLDGSLSIGQGMAARANSLQLLSPQPGEQLPPEMTVARSSVKETSREGTSSFHTRQKSEGGVYHDPHSDDGTAPKENRHLYNDPVPRRVGSFYRVPSPRPDNSFHENNVSTRVSSLPSESSSGTNHSKRQPAFDPWKSPENISHSEQLKEKEKQGFFRSMKKKKKKSQTVPNSDSPDLLTLQKSIHSASTPSSRPKEWRPEKISDLQTQSQPLKSLRKLLHLSSASNHPASSDPRFQPLTAQQTKNSFSEIRIHPLSQASGGSSNIRQEPAPKGRPALQLPGQMDPGWHVSSVTRSATEGPSYSEQLGAKSGPNGHPYNRTNRSRMPNLNDLKETAL

SEQ ID NO: 21420 - protein, 68 aa, Homo sapiens
  Payload ID: 4307
  Gene Symbol: CDKL5
  Gene Name: cyclin-dependent kinase-like 5
  ENSP ID: ENSP00000485359
MKIPNIGNVMNKFEILGVVGEGAYGVVLKCRHKETHEIVAIKKFKDSEENEEVKETTLRELKMLRTLK

SEQ ID NO: 21421 - protein, 60 aa, Homo sapiens
  Payload ID: 4307
  Gene Symbol: CDKL5
  Gene Name: cyclin-dependent kinase-like 5
  ENSP ID: ENSP00000485581
MKIPNIGNVMNKFEILGVVGEGAYGVVLKCRHKETHEIVAIKKFKDSEENEEVKETTLRE

SEQ ID NO: 21422 - protein, 17 aa, Homo sapiens
  Payload ID: 4307
  Gene Symbol: CDKL5
  Gene Name: cyclin-dependent kinase-like 5
  ENSP ID: ENSP00000485625
MKIPNIGNVMNKFEILG

SEQ ID NO: 21423 - protein, 651 aa, Homo sapiens
  Payload ID: 4308
  Gene Symbol: CYLC1
  Gene Name: cylicin, basic protein of sperm head cytoskeleton 1
  Uniprot ID: P35663
  ENSP ID: ENSP00000331556
MSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLPEAPWIHKLL

SEQ ID NO: 21424 - protein, 68 aa, Homo sapiens
  Payload ID: 4308
  Gene Symbol: CYLC1
  Gene Name: cylicin, basic protein of sperm head cytoskeleton 1
  ENSP ID: ENSP00000480907
MSLPRLKVNIRTYDNSIPISESSRKSWNQKHFALTFPKPLQRGTNDKSRPLKSQITVTPEAPWIHKLL

SEQ ID NO: 21425 - protein, 348 aa, Homo sapiens
  Payload ID: 4309
  Gene Symbol: CYLC2
  Gene Name: cylicin, basic protein of sperm head cytoskeleton 2
  Uniprot ID: Q14093
  ENSP ID: ENSP00000417674
MSLPRFQRVNFGPYDNYIPVSELSKKSWNQQHFALLFPKPQRPGTKRRSKPSQIRDNTVSIIDEEQLRGDRRQPLWMYRSLMRISERPSVYLAARRQPLKPTRTVEVDSKAAEIGKKGEDKTTQKDTTDSESELKQGKKDSKKGKDIEKGKEEKLDAKKDSKKGKKDAEKGKDSATESEDEKGGAKKDNKKDKKDSNKGKDSATESEGEKGGTEKDSKKGKKDSKKGKDSAIELQAVKADEKKDEDGKKDANKGDESKDAKKDAKEIKKGKKDKKKPSSTDSDSKDDVKKESKKDATKDAKKVAKKDTEKESADSKKDAKKNAKKDAKKDAKKNAKKDEKKDAKKKGK

SEQ ID NO: 21426 - protein, 348 aa, Homo sapiens; identical to SEQ ID NO: 21425
  Payload ID: 4309
  Gene Symbol: CYLC2
  Gene Name: cylicin, basic protein of sperm head cytoskeleton 2
  Uniprot ID: Q14093
  ENSP ID: ENSP00000420256

SEQ ID NO: 21427 - protein, 348 aa, Homo sapiens; identical to SEQ ID NO: 21425
  Payload ID: 4309
  Gene Symbol: CYLC2
  Gene Name: cylicin, basic protein of sperm head cytoskeleton 2
  Uniprot ID: Q14093
  ENSP ID: ENSP00000478399

SEQ ID NO: 21428 - protein, 956 aa, Homo sapiens
  Payload ID: 4310
  Gene Symbol: CYLD
  Gene Name: cylindromatosis (turban tumor syndrome)
  Uniprot ID: Q9NQC7
  ENSP ID: ENSP00000308928
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPALSESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIQGCARRLLCDAYMCMYQSPTMSLYK

SEQ ID NO: 21429 - protein, 953 aa, Homo sapiens
  Payload ID: 4310
  Gene Symbol: CYLD
  Gene Name: cylindromatosis (turban tumor syndrome)
  Uniprot ID: Q9NQC7
  ENSP ID: ENSP00000381574
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIQGCARRLLCDAYMCMYQSPTMSLYK

SEQ ID NO: 21430 - protein, 956 aa, Homo sapiens; identical to SEQ ID NO: 21428
  Payload ID: 4310
  Gene Symbol: CYLD
  Gene Name: cylindromatosis (turban tumor syndrome)
  Uniprot ID: Q9NQC7
  ENSP ID: ENSP00000392025

SEQ ID NO: 21431 - protein, 953 aa, Homo sapiens; identical to SEQ ID NO: 21429
  Payload ID: 4310
  Gene Symbol: CYLD
  Gene Name: cylindromatosis (turban tumor syndrome)
  Uniprot ID: Q9NQC7
  ENSP ID: ENSP00000454515

SEQ ID NO: 21432 - protein, 33 aa, Homo sapiens
  Payload ID: 4310
  Gene Symbol: CYLD
  Gene Name: cylindromatosis (turban tumor syndrome)
  ENSP ID: ENSP00000455535
MSSGLWSQEKVTSPYWEERIFYLLLQECSVTDK

SEQ ID NO: 21433 - protein, 771 aa, Homo sapiens
  Payload ID: 4310
  Gene Symbol: CYLD
  Gene Name: cylindromatosis (turban tumor syndrome)
  ENSP ID: ENSP00000456488
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPESVTQERRPPKLAFMSRGVGDKGSSSHNKPKATGSTSDPGNRNRSELFYTLNGSSVDSQPQSKSKNTWYIDEAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIQGCARRLLCDAYMCMYQSPTMSLYK

SEQ ID NO: 21434 - protein, 304 aa, Homo sapiens
  Payload ID: 4310
  Gene Symbol: CYLD
  Gene Name: cylindromatosis (turban tumor syndrome)
  ENSP ID: ENSP00000456912
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIP

SEQ ID NO: 21435 - protein, 166 aa, Homo sapiens
  Payload ID: 4310
  Gene Symbol: CYLD
  Gene Name: cylindromatosis (turban tumor syndrome)
  ENSP ID: ENSP00000457108
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVE

SEQ ID NO: 21436 - protein, 953 aa, Homo sapiens; identical to SEQ ID NO: 21429
  Payload ID: 4310
  Gene Symbol: CYLD
  Gene Name: cylindromatosis (turban tumor syndrome)
  Uniprot ID: Q9NQC7
  ENSP ID: ENSP00000457576

SEQ ID NO: 21437 - protein, 66 aa, Homo sapiens
  Payload ID: 4310
  Gene Symbol: CYLD
  Gene Name: cylindromatosis (turban tumor syndrome)
  ENSP ID: ENSP00000458507
  MOD_RES (1)..(1): Any amino acid
XGCIPCQNMELFAVLCIETSHYVAFVKYGKDDSAWLFFDSMADRDGTENAFLLHVAQGSGFGAILH

SEQ ID NO: 21438 - protein, 910 aa, Homo sapiens
  Payload ID: 4310
  Gene Symbol: CYLD
  Gene Name: cylindromatosis (turban tumor syndrome)
  ENSP ID: ENSP00000462134
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDAALSDPAPTAFWCGPPVA

SEQ ID NO: 21439 - protein, 104 aa, Homo sapiens
  Payload ID: 4310
  Gene Symbol: CYLD
  Gene Name: cylindromatosis (turban tumor syndrome)
  ENSP ID: ENSP00000463197
ISAGKIKQFCKTCNTQVHLHPKRLNHKYNPVSLPKDLPDWDWRHGCIPCQNMELFAVLCIETSHYVAFVKYGKDDSAWLFFDSMADRDGTENAFLLHVAQGSGL

SEQ ID NO: 21440 - protein, 503 aa, Homo sapiens
  Payload ID: 4311
  Gene Symbol: CYP3A7-CYP3A51P
  Gene Name: CYP3A7-CYP3A51P readthrough
  ENSP ID: ENSP00000479282
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRLGGLLQPEKPIVLKVESRDGTVSGT

SEQ ID NO: 21441 - protein, 535 aa, Homo sapiens
  Payload ID: 4311
  Gene Symbol: CYP3A7-CYP3A51P
  Gene Name: CYP3A7-CYP3A51P readthrough
  Uniprot ID: P24462
  ENSP ID: ENSP00000480571
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETFVDMEPIHMDFLRSLAFQGPHLCFFWELLCPTIRSR

SEQ ID NO: 21442 - protein, 361 aa, Homo sapiens
  Payload ID: 4312
  Gene Symbol: CTH
  Gene Name: cystathionine gamma-lyase
  Uniprot ID: P32929
  ENSP ID: ENSP00000311554
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 21443 - protein, 405 aa, Homo sapiens
  Payload ID: 4312
  Gene Symbol: CTH
  Gene Name: cystathionine gamma-lyase
  Uniprot ID: P32929
  ENSP ID: ENSP00000359976
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 21444 - protein, 373 aa, Homo sapiens
  Payload ID: 4312
  Gene Symbol: CTH
  Gene Name: cystathionine gamma-lyase
  Uniprot ID: P32929
  ENSP ID: ENSP00000413407
MQEKDASSQGFLPHFQHFATQAIHVGQDPEQWTSRAVVPPISLSTTFKQGAPGQHSGFEYSRSGNPTRNCLEKAVAALDGAKYCTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 21445 - protein, 551 aa, Homo sapiens
  Payload ID: 4313
  Gene Symbol: CBS
  Gene Name: cystathionine-beta-synthase
  Uniprot ID: P35520
  ENSP ID: ENSP00000344460
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 21446 - protein, 551 aa, Homo sapiens; identical to SEQ ID NO: 21445
  Payload ID: 4313
  Gene Symbol: CBS
  Gene Name: cystathionine-beta-synthase
  Uniprot ID: P35520
  ENSP ID: ENSP00000352643

SEQ ID NO: 21447 - protein, 551 aa, Homo sapiens; identical to SEQ ID NO: 21445
  Payload ID: 4313
  Gene Symbol: CBS
  Gene Name: cystathionine-beta-synthase
  Uniprot ID: P35520
  ENSP ID: ENSP00000381225

SEQ ID NO: 21448 - protein, 551 aa, Homo sapiens; identical to SEQ ID NO: 21445
  Payload ID: 4313
  Gene Symbol: CBS
  Gene Name: cystathionine-beta-synthase
  Uniprot ID: P35520
  ENSP ID: ENSP00000381231

SEQ ID NO: 21449 - protein, 177 aa, Homo sapiens
  Payload ID: 4313
  Gene Symbol: CBS
  Gene Name: cystathionine-beta-synthase
  ENSP ID: ENSP00000388235
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEK

SEQ ID NO: 21450 - protein, 149 aa, Homo sapiens
  Payload ID: 4313
  Gene Symbol: CBS
  Gene Name: cystathionine-beta-synthase
  ENSP ID: ENSP00000402823
  MOD_RES (1)..(1): Any amino acid
XGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPADHSTGKSSQRQMVFGVVTAIDLLNFVAAQERDQK

SEQ ID NO: 21451 - protein, 224 aa, Homo sapiens
  Payload ID: 4313
  Gene Symbol: CBS
  Gene Name: cystathionine-beta-synthase
  ENSP ID: ENSP00000405929
  MOD_RES (1)..(1): Any amino acid
XGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAGSPNQVFLEHVHACHHRLWLLSSTSGLRAHNRDGTAPKT

SEQ ID NO: 21452 - protein, 159 aa, Homo sapiens
  Payload ID: 4313
  Gene Symbol: CBS
  Gene Name: cystathionine-beta-synthase
  ENSP ID: ENSP00000408014
  MOD_RES (1)..(1): Any amino acid
XVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAEKKKDANSNVRVPKSSLPGACPRLSPPSVAAFKHVRAACS

SEQ ID NO: 21453 - protein, 551 aa, Homo sapiens; identical to SEQ ID NO: 21445
  Payload ID: 4314
  Gene Symbol: CBSL
  Gene Name: cystathionine-beta-synthase like
  Uniprot ID: P35520
  ENSP ID: ENSP00000381234

SEQ ID NO: 21454 - protein, 551 aa, Homo sapiens; identical to SEQ ID NO: 21445
  Payload ID: 4314
  Gene Symbol: CBSL
  Gene Name: cystathionine-beta-synthase like
  Uniprot ID: P35520
  ENSP ID: ENSP00000479559

SEQ ID NO: 21455 - protein, 551 aa, Homo sapiens; identical to SEQ ID NO: 21445
  Payload ID: 4314
  Gene Symbol: CBSL
  Gene Name: cystathionine-beta-synthase like
  Uniprot ID: P35520
  ENSP ID: ENSP00000481719

SEQ ID NO: 21456 - protein, 565 aa, Homo sapiens
  Payload ID: 4314
  Gene Symbol: CBSL
  Gene Name: cystathionine-beta-synthase like
  Uniprot ID: P35520
  ENSP ID: ENSP00000485527
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPADHSTGKSSQRQMVFGVVTAIDLLNFVAAQERDQK

SEQ ID NO: 21457 - protein, 551 aa, Homo sapiens; identical to SEQ ID NO: 21445
  Payload ID: 4314
  Gene Symbol: CBSL
  Gene Name: cystathionine-beta-synthase like
  Uniprot ID: P35520
  ENSP ID: ENSP00000485669

SEQ ID NO: 21458 - protein, 103 aa, Homo sapiens
  Payload ID: 4315
  Gene Symbol: CST11
  Gene Name: cystatin 11
  Uniprot ID: Q9H112
  ENSP ID: ENSP00000366206
MMAEPWQALQLLLAILLTLMALPYQARKKTFLSVHEVMAVENYAKDSLQWITDQYNKESDDKYHFRIFRVLKVQRQQVNCFFSVFAVPWFEQYKILNKSCSSD

SEQ ID NO: 21459 - protein, 138 aa, Homo sapiens
  Payload ID: 4315
  Gene Symbol: CST11
  Gene Name: cystatin 11
  Uniprot ID: Q9H112
  ENSP ID: ENSP00000366208
MMAEPWQALQLLLAILLTLMALPYQARKKTFLSVHEVMAVENYAKDSLQWITDQYNKESDDKYHFRIFRVLKVQRQVTDHLEYHLNVEMQWTTCQKPETTNCVPQERELHKQVNCFFSVFAVPWFEQYKILNKSCSSD

SEQ ID NO: 21460 - protein, 142 aa, Homo sapiens
  Payload ID: 4316
  Gene Symbol: CST8
  Gene Name: cystatin 8 (cystatin-related epididymal specific)
  Uniprot ID: O60676
  ENSP ID: ENSP00000246012
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 21461 - protein, 134 aa, Homo sapiens
  Payload ID: 4316
  Gene Symbol: CST8
  Gene Name: cystatin 8 (cystatin-related epididymal specific)
  ENSP ID: ENSP00000399144
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTV

SEQ ID NO: 21462 - protein, 159 aa, Homo sapiens
  Payload ID: 4317
  Gene Symbol: CST9
  Gene Name: cystatin 9 (testatin)
  Uniprot ID: Q5W186
  ENSP ID: ENSP00000366170
MSSPQRRKAMPWALSLLLMGFQLLVTYAWCSEEEMGGNNKIVQDPMFLATVEFALNTFNVQSKEEHAYRLLRVLSSWREDSMDRKWRGKMVFSMNLQLRQTVCRKFEDDIDNCPFQESLELNNVRQGISFPQVHSCGCCMGCGVGTGAADKAIPRDKGK

SEQ ID NO: 21463 - protein, 147 aa, Homo sapiens
  Payload ID: 4318
  Gene Symbol: CST9L
  Gene Name: cystatin 9-like
  Uniprot ID: Q9H4G1
  ENSP ID: ENSP00000366178
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 21464 - protein, 98 aa, Homo sapiens
  Payload ID: 4319
  Gene Symbol: CSTA
  Gene Name: cystatin A (stefin A)
  Uniprot ID: P01040
  ENSP ID: ENSP00000264474
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 21465 - protein, 63 aa, Homo sapiens
  Payload ID: 4319
  Gene Symbol: CSTA
  Gene Name: cystatin A (stefin A)
  ENSP ID: ENSP00000418891
MIPGGLSEAKPATPEIQEIVDKVKPQLEEKTNETYGKLEAVQYKTQVVAGTNYYIKVRVQHLL

SEQ ID NO: 21466 - protein, 98 aa, Homo sapiens
  Payload ID: 4320
  Gene Symbol: CSTB
  Gene Name: cystatin B (stefin B)
  Uniprot ID: P04080
  ENSP ID: ENSP00000291568
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 21467 - protein, 146 aa, Homo sapiens
  Payload ID: 4321
  Gene Symbol: CST3
  Gene Name: cystatin C
  Uniprot ID: P01034
  ENSP ID: ENSP00000366124
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 21468 - protein, 146 aa, Homo sapiens; identical to SEQ ID NO: 21467
  Payload ID: 4321
  Gene Symbol: CST3
  Gene Name: cystatin C
  Uniprot ID: P01034
  ENSP ID: ENSP00000381446

SEQ ID NO: 21469 - protein, 146 aa, Homo sapiens; identical to SEQ ID NO: 21467
  Payload ID: 4321
  Gene Symbol: CST3
  Gene Name: cystatin C
  Uniprot ID: P01034
  ENSP ID: ENSP00000381448

SEQ ID NO: 21470 - protein, 142 aa, Homo sapiens
  Payload ID: 4322
  Gene Symbol: CST5
  Gene Name: cystatin D
  Uniprot ID: P28325
  ENSP ID: ENSP00000307132
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 21471 - protein, 149 aa, Homo sapiens
  Payload ID: 4323
  Gene Symbol: CST6
  Gene Name: cystatin E/M
  Uniprot ID: Q15828
  ENSP ID: ENSP00000311313
MARSNLPLALGLALVAFCLLALPRDARARPQERMVGELRDLSPDDPQVQKAAQAAVASYNMGSNSIYYFRDTHIIKAQSQLVAGIKYFLTMEMGSTDCRKTRVTGDHVDLTTCPLAAGAQQEKLRCDFEVLVVPWQNSSQLLKHNCVQM

SEQ ID NO: 21472 - protein, 145 aa, Homo sapiens
  Payload ID: 4324
  Gene Symbol: CST7
  Gene Name: cystatin F (leukocystatin)
  Uniprot ID: O76096
  ENSP ID: ENSP00000420384
MRAAGTLLAFCCLVLSTTGGPSPDTCSQDLNSRVKPGFPKTIKTNDPGVLQAARYSVEKFNNCTNDMFLFKESRITRALVQIVKGLKYMLEVEIGRTTCKKNQHLRLDDCDFQTNHTLKQTLSCYSEVWVVPWLQHFEVPVLRCH

SEQ ID NO: 21473 - protein, 141 aa, Homo sapiens
  Payload ID: 4325
  Gene Symbol: CST4
  Gene Name: cystatin S
  Uniprot ID: P01036
  ENSP ID: ENSP00000217423
MARPLCTLLLLMATLAGALASSSKEENRIIPGGIYDADLNDEWVQRALHFAISEYNKATEDEYYRRPLQVLRAREQTFGGVNYFFDVEVGRTICTKSQPNLDTCAFHEQPELQKKQLCSFEIYEVPWEDRMSLVNSRCQEA

SEQ ID NO: 21474 - protein, 141 aa, Homo sapiens
  Payload ID: 4326
  Gene Symbol: CST2
  Gene Name: cystatin SA
  Uniprot ID: P09228
  ENSP ID: ENSP00000307540
MAWPLCTLLLLLATQAVALAWSPQEEDRIIEGGIYDADLNDERVQRALHFVISEYNKATEDEYYRRLLRVLRAREQIVGGVNYFFDIEVGRTICTKSQPNLDTCAFHEQPELQKKQLCSFQIYEVPWEDRMSLVNSRCQEA

SEQ ID NO: 21475 - protein, 141 aa, Homo sapiens
  Payload ID: 4327
  Gene Symbol: CST1
  Gene Name: cystatin SN
  Uniprot ID: P01037
  ENSP ID: ENSP00000305731
MAQYLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 21476 - protein, 141 aa, Homo sapiens; identical to SEQ ID NO: 21475
  Payload ID: 4327
  Gene Symbol: CST1
  Gene Name: cystatin SN
  Uniprot ID: P01037
  ENSP ID: ENSP00000381439

SEQ ID NO: 21477 - protein, 145 aa, Homo sapiens
  Payload ID: 4328
  Gene Symbol: CSTL1
  Gene Name: cystatin-like 1
  Uniprot ID: Q9H114
  ENSP ID: ENSP00000246020
MGIGCWRNPLLLLIALVLSAKLGHFQRWEGFQQKLMSKKNMNSTLNFFIQSYNNASNDTYLYRVQRLIRSQMQLTTGVEYIVTVKIGWTKCKRNDTSNSSCPLQSKKLRKSLICESLIYTMPWINYFQLWNNSCLEAEHVGRNLR

SEQ ID NO: 21478 - protein, 145 aa, Homo sapiens; identical to SEQ ID NO: 21477
  Payload ID: 4328
  Gene Symbol: CSTL1
  Gene Name: cystatin-like 1
  Uniprot ID: Q9H114
  ENSP ID: ENSP00000344907

SEQ ID NO: 21479 - protein, 37 aa, Homo sapiens
  Payload ID: 4328
  Gene Symbol: CSTL1
  Gene Name: cystatin-like 1
  ENSP ID: ENSP00000477757
MNSTLNFFIQSYNNASNDTYLYRVQRLIRSQMQQVHC

SEQ ID NO: 21480 - protein, 193 aa, Homo sapiens
  Payload ID: 4329
  Gene Symbol: CSRP1
  Gene Name: cysteine and glycine-rich protein 1
  Uniprot ID: P21291
  ENSP ID: ENSP00000345079
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 21481 - protein, 193 aa, Homo sapiens; identical to SEQ ID NO: 21480
  Payload ID: 4329
  Gene Symbol: CSRP1
  Gene Name: cysteine and glycine-rich protein 1
  Uniprot ID: P21291
  ENSP ID: ENSP00000356275

SEQ ID NO: 21482 - protein, 153 aa, Homo sapiens
  Payload ID: 4329
  Gene Symbol: CSRP1
  Gene Name: cysteine and glycine-rich protein 1
  ENSP ID: ENSP00000432110
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKDPKVRMLFDLLKHLVPCLMGGS

SEQ ID NO: 21483 - protein, 193 aa, Homo sapiens; identical to SEQ ID NO: 21480
  Payload ID: 4329
  Gene Symbol: CSRP1
  Gene Name: cysteine and glycine-rich protein 1
  Uniprot ID: P21291
  ENSP ID: ENSP00000434147

SEQ ID NO: 21484 - protein, 160 aa, Homo sapiens
  Payload ID: 4329
  Gene Symbol: CSRP1
  Gene Name: cysteine and glycine-rich protein 1
  ENSP ID: ENSP00000436491
MPNWGGGKKCGVCQKTVYFAEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 21485 - protein, 193 aa, Homo sapiens; identical to SEQ ID NO: 21480
  Payload ID: 4329
  Gene Symbol: CSRP1
  Gene Name: cysteine and glycine-rich protein 1
  Uniprot ID: P21291
  ENSP ID: ENSP00000436792

SEQ ID NO: 21486 - protein, 153 aa, Homo sapiens
  Payload ID: 4329
  Gene Symbol: CSRP1
  Gene Name: cysteine and glycine-rich protein 1
  ENSP ID: ENSP00000437218
MVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALV

SEQ ID NO: 21487 - protein, 17 aa, Homo sapiens
  Payload ID: 4329
  Gene Symbol: CSRP1
  Gene Name: cysteine and glycine-rich protein 1
  ENSP ID: ENSP00000483864
MPNWGGGKKSGALVHSE

SEQ ID NO: 21488 - protein, 193 aa, Homo sapiens
  Payload ID: 4330
  Gene Symbol: CSRP2
  Gene Name: cysteine and glycine-rich protein 2
  Uniprot ID: Q16527
  ENSP ID: ENSP00000310901
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 21489 - protein, 243 aa, Homo sapiens
  Payload ID: 4330
  Gene Symbol: CSRP2
  Gene Name: cysteine and glycine-rich protein 2
  ENSP ID: ENSP00000449824
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESIPSCIKESCSQKQVICIYFNFTAPWRPDVMKLNGREMCCVNHERCFSCAIVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 21490 - protein, 193 aa, Homo sapiens; identical to SEQ ID NO: 21488
  Payload ID: 4330
  Gene Symbol: CSRP2
  Gene Name: cysteine and glycine-rich protein 2
  Uniprot ID: Q16527
  ENSP ID: ENSP00000450056

SEQ ID NO: 21491 - protein, 187 aa, Homo sapiens
  Payload ID: 4330
  Gene Symbol: CSRP2
  Gene Name: cysteine and glycine-rich protein 2
  ENSP ID: ENSP00000450143
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGKIHFSYCCPYEYSTLVLV

SEQ ID NO: 21492 - protein, 194 aa, Homo sapiens
  Payload ID: 4331
  Gene Symbol: CSRP3
  Gene Name: cysteine and glycine-rich protein 3 (cardiac LIM protein)
  Uniprot ID: P50461
  ENSP ID: ENSP00000265968
MPNWGGGAKCGACEKTVYHAEEIQCNGRSFHKTCFHCMACRKALDSTTVAAHESEIYCKVCYGRRYGPKGIGYGQGAGCLSTDTGEHLGLQFQQSPKPARSVTTSNPSKFTAKFGESEKCPRCGKSVYAAEKVMGGGKPWHKTCFRCAICGKSLESTNVTDKDGELYCKVCYAKNFGPTGIGFGGLTQQVEKKE

SEQ ID NO: 21493 - protein, 194 aa, Homo sapiens; identical to SEQ ID NO: 21492
  Payload ID: 4331
  Gene Symbol: CSRP3
  Gene Name: cysteine and glycine-rich protein 3 (cardiac LIM protein)
  Uniprot ID: P50461
  ENSP ID: ENSP00000431813

SEQ ID NO: 21494 - protein, 332 aa, Homo sapiens
  Payload ID: 4332
  Gene Symbol: CHORDC1
  Gene Name: cysteine and histidine-rich domain (CHORD) containing 1
  Uniprot ID: Q9UHD1
  ENSP ID: ENSP00000319255
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 21495 - protein, 313 aa, Homo sapiens
  Payload ID: 4332
  Gene Symbol: CHORDC1
  Gene Name: cysteine and histidine-rich domain (CHORD) containing 1
  Uniprot ID: Q9UHD1
  ENSP ID: ENSP00000401080
MALLCYNRGCGQRFDPETNSDDACTYHPGVPVFHDALKGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 21496 - protein, 116 aa, Homo sapiens
  Payload ID: 4332
  Gene Symbol: CHORDC1
  Gene Name: cysteine and histidine-rich domain (CHORD) containing 1
  ENSP ID: ENSP00000431929
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPRSSSCYT

SEQ ID NO: 21497 - protein, 117 aa, Homo sapiens
  Payload ID: 4332
  Gene Symbol: CHORDC1
  Gene Name: cysteine and histidine-rich domain (CHORD) containing 1
  ENSP ID: ENSP00000432019
MALLCYNRGCGQRFDPETNSDGKRNAPPALPPLHLISRGGPLGRRVSADLLQPSSRGPRSMPLLGLPWLPAQPAGRPSVAPRSLGERPAPAPDCPLPLRRETLPWIHVFPPSSPHSF

SEQ ID NO: 21498 - protein, 39 aa, Homo sapiens
  Payload ID: 4332
  Gene Symbol: CHORDC1
  Gene Name: cysteine and histidine-rich domain (CHORD) containing 1
  ENSP ID: ENSP00000433440
MALLCYNRGCGQRFDPETNSDDACTYHPGVPVFHDALKS

SEQ ID NO: 21499 - protein, 144 aa, Homo sapiens
  Payload ID: 4332
  Gene Symbol: CHORDC1
  Gene Name: cysteine and histidine-rich domain (CHORD) containing 1
  ENSP ID: ENSP00000433719
MKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 21500 - protein, 120 aa, Homo sapiens
  Payload ID: 4332
  Gene Symbol: CHORDC1
  Gene Name: cysteine and histidine-rich domain (CHORD) containing 1
  ENSP ID: ENSP00000434040
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPRFQNSPAQMNQ

SEQ ID NO: 21501 - protein, 144 aa, Homo sapiens; identical to SEQ ID NO: 21499
  Payload ID: 4332
  Gene Symbol: CHORDC1
  Gene Name: cysteine and histidine-rich domain (CHORD) containing 1
  ENSP ID: ENSP00000436632

SEQ ID NO: 21502 - protein, 184 aa, Homo sapiens
  Payload ID: 4332
  Gene Symbol: CHORDC1
  Gene Name: cysteine and histidine-rich domain (CHORD) containing 1
  ENSP ID: ENSP00000436945
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKSLHLQQQWGPDLPDKPWIYI

SEQ ID NO: 21503 - protein, 454 aa, Homo sapiens
  Payload ID: 4333
  Gene Symbol: CCBL2
  Gene Name: cysteine conjugate-beta lyase 2
  Uniprot ID: Q6YP21
  ENSP ID: ENSP00000260508
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 21504 - protein, 175 aa, Homo sapiens
  Payload ID: 4333
  Gene Symbol: CCBL2
  Gene Name: cysteine conjugate-beta lyase 2
  ENSP ID: ENSP00000359516
MVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPETLI

SEQ ID NO: 21505 - protein, 262 aa, Homo sapiens
  Payload ID: 4333
  Gene Symbol: CCBL2
  Gene Name: cysteine conjugate-beta lyase 2
  ENSP ID: ENSP00000359517
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKI

SEQ ID NO: 21506 - protein, 420 aa, Homo sapiens
  Payload ID: 4333
  Gene Symbol: CCBL2
  Gene Name: cysteine conjugate-beta lyase 2
  Uniprot ID: Q6YP21
  ENSP ID: ENSP00000359522
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 21507 - protein, 422 aa, Homo sapiens
  Payload ID: 4334
  Gene Symbol: CCBL1
  Gene Name: cysteine conjugate-beta lyase, cytoplasmic
  Uniprot ID: Q16773
  ENSP ID: ENSP00000302227
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 21508 - protein, 372 aa, Homo sapiens
  Payload ID: 4334
  Gene Symbol: CCBL1
  Gene Name: cysteine conjugate-beta lyase, cytoplasmic
  Uniprot ID: Q16773
  ENSP ID: ENSP00000317342
MAKQLQARRLDGIDYNPWVEFVKLASEHDVVNLGQGFPDFPPPDFAVEAFQHAVSGDFMLNQYTKTFVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 21509 - protein, 251 aa, Homo sapiens
  Payload ID: 4334
  Gene Symbol: CCBL1
  Gene Name: cysteine conjugate-beta lyase, cytoplasmic
  ENSP ID: ENSP00000390377
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSA

SEQ ID NO: 21510 - protein, 159 aa, Homo sapiens
  Payload ID: 4334
  Gene Symbol: CCBL1
  Gene Name: cysteine conjugate-beta lyase, cytoplasmic
  ENSP ID: ENSP00000392354
AMAKQLQARRLDGIDYNPWVEFVKLASEHDVVNLGQGFPDFPPPDFAVEAFQHAVSGDFMLNQYTKTFVSLCYPGWSAMVRSWSTAALTLPVSSGPPTSASGVTGTTGWSQSWLESSFFDPKKKKIIWGYPPLTKILASFFGELLGQEIDPLRNVLVTV

SEQ ID NO: 21511 - protein, 516 aa, Homo sapiens
  Payload ID: 4334
  Gene Symbol: CCBL1
  Gene Name: cysteine conjugate-beta lyase, cytoplasmic
  ENSP ID: ENSP00000399415
MFRTAAAISVHLVGPLQGRKAGAPLTWFLHQTQVAEKNVGSPAPRPTSHLGLANPQERKVPQGPQSPCEVPAAEGILRTGGAKLPIQGHPAKLAMAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 21512 - protein, 184 aa, Homo sapiens
  Payload ID: 4334
  Gene Symbol: CCBL1
  Gene Name: cysteine conjugate-beta lyase, cytoplasmic
  ENSP ID: ENSP00000412402
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPN

SEQ ID NO: 21513 - protein, 200 aa, Homo sapiens
  Payload ID: 4335
  Gene Symbol: CDO1
  Gene Name: cysteine dioxygenase type 1
  Uniprot ID: Q16878
  ENSP ID: ENSP00000250535
MEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 21514 - protein, 1036 aa, Homo sapiens
  Payload ID: 4336
  Gene Symbol: CRIM1
  Gene Name: cysteine rich transmembrane BMP regulator 1 (chordin-like)
  Uniprot ID: Q9NZV1
  ENSP ID: ENSP00000280527
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 21515 - protein, 175 aa, Homo sapiens
  Payload ID: 4336
  Gene Symbol: CRIM1
  Gene Name: cysteine rich transmembrane BMP regulator 1 (chordin-like)
  ENSP ID: ENSP00000403120
ALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIGGQT

SEQ ID NO: 21516 - protein, 222 aa, Homo sapiens
  Payload ID: 4336
  Gene Symbol: CRIM1
  Gene Name: cysteine rich transmembrane BMP regulator 1 (chordin-like)
  ENSP ID: ENSP00000407636
CPGSIVQGVCGCCYTCASQRNESCGGTFGIYGTCDRGLRCVIRPPLNGDSLTEYEAGVCEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVN

SEQ ID NO: 21517 - protein, 55 aa, Homo sapiens
  Payload ID: 4336
  Gene Symbol: CRIM1
  Gene Name: cysteine rich transmembrane BMP regulator 1 (chordin-like)
  ENSP ID: ENSP00000415706
  MOD_RES (1)..(1): Any amino acid
XGCCYTCASQRNESCGGTFGIYGTCDRGLRCVIRPPLNGDSLTEYEAGVCEAAGY

SEQ ID NO: 21518 - protein, 110 aa, Homo sapiens
  Payload ID: 4336
  Gene Symbol: CRIM1
  Gene Name: cysteine rich transmembrane BMP regulator 1 (chordin-like)
  ENSP ID: ENSP00000478123
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCE

SEQ ID NO: 21519 - protein, 60 aa, Homo sapiens
  Payload ID: 4336
  Gene Symbol: CRIM1
  Gene Name: cysteine rich transmembrane BMP regulator 1 (chordin-like)
  ENSP ID: ENSP00000480932
CPGSIVQGVCGCCYTCASQRNESCGGTFGIYGTCDRGLRCVIRPPLNGDSLTEYEAGVCE

SEQ ID NO: 21520 - protein, 51 aa, Homo sapiens
  Payload ID: 4336
  Gene Symbol: CRIM1
  Gene Name: cysteine rich transmembrane BMP regulator 1 (chordin-like)
  ENSP ID: ENSP00000480938
  MOD_RES (1)..(1): Any amino acid
XGCCYTCASQRNESCGGTFGIYGTCDRGLRCVIRPPLNGDSLTEYEAGVCE

SEQ ID NO: 21521 - protein, 520 aa, Homo sapiens
  Payload ID: 4337
  Gene Symbol: CSAD
  Gene Name: cysteine sulfinic acid decarboxylase
  Uniprot ID: Q9Y600
  ENSP ID: ENSP00000267085
MSIPLKSSFLLSYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 21522 - protein, 267 aa, Homo sapiens
  Payload ID: 4337
  Gene Symbol: CSAD
  Gene Name: cysteine sulfinic acid decarboxylase
  ENSP ID: ENSP00000369172
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKEVGKRHRPNPGLLILISSHVTTPSRRELRFWDLAPTVSEWSRLMREGKWSPRIWRGRLVWPRLRVLCRSWSVPPLAPLC

SEQ ID NO: 21523 - protein, 346 aa, Homo sapiens
  Payload ID: 4337
  Gene Symbol: CSAD
  Gene Name: cysteine sulfinic acid decarboxylase
  Uniprot ID: Q9Y600
  ENSP ID: ENSP00000369175
MADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 21524 - protein, 519 aa, Homo sapiens
  Payload ID: 4337
  Gene Symbol: CSAD
  Gene Name: cysteine sulfinic acid decarboxylase
  ENSP ID: ENSP00000369179
  MOD_RES (1)..(1): Any amino acid
XLGDARRGAAGYLCTLPPALLSREILMADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 21525 - protein, 45 aa, Homo sapiens
  Payload ID: 4337
  Gene Symbol: CSAD
  Gene Name: cysteine sulfinic acid decarboxylase
  ENSP ID: ENSP00000390269
MADSEALPSLAGDPVAVEALLRAVFGVVVDEAIQKGTSVSQKVHI

SEQ ID NO: 21526 - protein, 146 aa, Homo sapiens
  Payload ID: 4337
  Gene Symbol: CSAD
  Gene Name: cysteine sulfinic acid decarboxylase
  ENSP ID: ENSP00000401078
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDG

SEQ ID NO: 21527 - protein, 493 aa, Homo sapiens
  Payload ID: 4337
  Gene Symbol: CSAD
  Gene Name: cysteine sulfinic acid decarboxylase
  Uniprot ID: Q9Y600
  ENSP ID: ENSP00000410648
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 21528 - protein, 163 aa, Homo sapiens
  Payload ID: 4337
  Gene Symbol: CSAD
  Gene Name: cysteine sulfinic acid decarboxylase
  ENSP ID: ENSP00000415314
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLA

SEQ ID NO: 21529 - protein, 493 aa, Homo sapiens; identical to SEQ ID NO: 21527
  Payload ID: 4337
  Gene Symbol: CSAD
  Gene Name: cysteine sulfinic acid decarboxylase
  Uniprot ID: Q9Y600
  ENSP ID: ENSP00000415485

SEQ ID NO: 21530 - protein, 267 aa, Homo sapiens; identical to SEQ ID NO: 21522
  Payload ID: 4337
  Gene Symbol: CSAD
  Gene Name: cysteine sulfinic acid decarboxylase
  ENSP ID: ENSP00000436800

SEQ ID NO: 21531 - protein, 135 aa, Homo sapiens
  Payload ID: 4337
  Gene Symbol: CSAD
  Gene Name: cysteine sulfinic acid decarboxylase
  ENSP ID: ENSP00000449373
MADSEALPSLAGDPVAVEALLRAVFGVVVDEAIQKGTSVSQKCHYSIQKGAAFLGLGTDSVRVVKADERGKMVPEDLERQIGMAEAEGAVPFLVSATSGTTVLGAFDPLEAIADVCQRHGLWLHVDAAWGGSVLL

SEQ ID NO: 21532 - protein, 142 aa, Homo sapiens
  Payload ID: 4337
  Gene Symbol: CSAD
  Gene Name: cysteine sulfinic acid decarboxylase
  ENSP ID: ENSP00000455618
IQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPVSLLHPEGSCVSGTWHRQCPSGQG

SEQ ID NO: 21533 - protein, 129 aa, Homo sapiens
  Payload ID: 4337
  Gene Symbol: CSAD
  Gene Name: cysteine sulfinic acid decarboxylase
  ENSP ID: ENSP00000457264
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEE

SEQ ID NO: 21534 - protein, 192 aa, Homo sapiens
  Payload ID: 4338
  Gene Symbol: CYHR1
  Gene Name: cysteine/histidine-rich 1
  Uniprot ID: Q6ZMK1
  ENSP ID: ENSP00000304826
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 21535 - protein, 192 aa, Homo sapiens; identical to SEQ ID NO: 21534
  Payload ID: 4338
  Gene Symbol: CYHR1
  Gene Name: cysteine/histidine-rich 1
  Uniprot ID: Q6ZMK1
  ENSP ID: ENSP00000385962

SEQ ID NO: 21536 - protein, 362 aa, Homo sapiens
  Payload ID: 4338
  Gene Symbol: CYHR1
  Gene Name: cysteine/histidine-rich 1
  Uniprot ID: Q6ZMK1
  ENSP ID: ENSP00000387426
MAPKPGAEWSTALSHLVLGVVSLHAAVSTAEASRGAAAGFLLQVLAATTTLAPGLSTHEDCLAGAWVATVIGLPLLAFDFHWCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 21537 - protein, 192 aa, Homo sapiens; identical to SEQ ID NO: 21534
  Payload ID: 4338
  Gene Symbol: CYHR1
  Gene Name: cysteine/histidine-rich 1
  Uniprot ID: Q6ZMK1
  ENSP ID: ENSP00000414647

SEQ ID NO: 21538 - protein, 143 aa, Homo sapiens
  Payload ID: 4338
  Gene Symbol: CYHR1
  Gene Name: cysteine/histidine-rich 1
  ENSP ID: ENSP00000432902
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGG

SEQ ID NO: 21539 - protein, 404 aa, Homo sapiens
  Payload ID: 4338
  Gene Symbol: CYHR1
  Gene Name: cysteine/histidine-rich 1
  ENSP ID: ENSP00000433769
MSGAEEAGGGGPAAGPAGSVPAGVGVGVGAGPGAAAGQAAAAALGEAAGPGLPDEAGLAGARQLQLQEAAGDPDAPPKKRLRAAEAAEAAAAAAAAGSGKLEERLYSVLCCTVCLDLPKASVYQCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 21540 - protein, 246 aa, Homo sapiens
  Payload ID: 4338
  Gene Symbol: CYHR1
  Gene Name: cysteine/histidine-rich 1
  ENSP ID: ENSP00000434470
MAPKPGAEWSTALSHLVLGVVSLHAAVSTAECTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPL

SEQ ID NO: 21541 - protein, 42 aa, Homo sapiens
  Payload ID: 4338
  Gene Symbol: CYHR1
  Gene Name: cysteine/histidine-rich 1
  ENSP ID: ENSP00000434642
MAPKPGAEWSTALSHLVLGVVSLHAAVSTAEASRGAAAGFLL

SEQ ID NO: 21542 - protein, 154 aa, Homo sapiens
  Payload ID: 4339
  Gene Symbol: CYYR1
  Gene Name: cysteine/tyrosine-rich 1
  Uniprot ID: Q96J86
  ENSP ID: ENSP00000299340
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 21543 - protein, 132 aa, Homo sapiens
  Payload ID: 4339
  Gene Symbol: CYYR1
  Gene Name: cysteine/tyrosine-rich 1
  Uniprot ID: Q96J86
  ENSP ID: ENSP00000382918
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPEYELHEAEILVYFVQHSIPSM

SEQ ID NO: 21544 - protein, 99 aa, Homo sapiens
  Payload ID: 4340
  Gene Symbol: CRCT1
  Gene Name: cysteine-rich C-terminal 1
  Uniprot ID: Q9UGL9
  ENSP ID: ENSP00000357779
MSSQQSAVSAKGFSKGSSQGPAPCPAPAPTPAPASSSSCCGSGRGCCGDSGCCGSSSTSCCCFPRRRRRQRSSGCCCCGGGSQRSQRSNNRSSGCCSGC

SEQ ID NO: 21545 - protein, 224 aa, Homo sapiens
  Payload ID: 4341
  Gene Symbol: CHIC1
  Gene Name: cysteine-rich hydrophobic domain 1
  Uniprot ID: Q5VXU3
  ENSP ID: ENSP00000362601
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKLALHWKLTKRKCETSNMMEYVILIEFLPKYPIFRPD

SEQ ID NO: 21546 - protein, 204 aa, Homo sapiens
  Payload ID: 4341
  Gene Symbol: CHIC1
  Gene Name: cysteine-rich hydrophobic domain 1
  Uniprot ID: Q5VXU3
  ENSP ID: ENSP00000362603
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKVILIEFLPKYPIFRPD

SEQ ID NO: 21547 - protein, 217 aa, Homo sapiens
  Payload ID: 4341
  Gene Symbol: CHIC1
  Gene Name: cysteine-rich hydrophobic domain 1
  ENSP ID: ENSP00000432985
MAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKLALHWKLTKRKCETSNMMEYVILIEFLPKYPIFRPD

SEQ ID NO: 21548 - protein, 64 aa, Homo sapiens
  Payload ID: 4341
  Gene Symbol: CHIC1
  Gene Name: cysteine-rich hydrophobic domain 1
  ENSP ID: ENSP00000473482
  MOD_RES (1)..(1): Any amino acid
XEEEEEEEEEEEEAPPPPRVVSEEHLRRYAPDPVLVRGAGHITVFGLSNKFDTEFPSVLTGKKF

SEQ ID NO: 21549 - protein, 165 aa, Homo sapiens
  Payload ID: 4342
  Gene Symbol: CHIC2
  Gene Name: cysteine-rich hydrophobic domain 2
  Uniprot ID: Q9UKJ5
  ENSP ID: ENSP00000263921
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 21550 - protein, 137 aa, Homo sapiens
  Payload ID: 4342
  Gene Symbol: CHIC2
  Gene Name: cysteine-rich hydrophobic domain 2
  ENSP ID: ENSP00000421032
  MOD_RES (1)..(1): Any amino acid
XADFDEIYEEEEDEERALEEQLLKYSPDPVVVRGSGHVTVFGLSNKFESEFPSSLTGKVAPEEFKASINRVNSCLKKNLPVNTRRSIEKLLEWENNRLYHKLCLHWRLSKRKCETNNMMEYVILIEFLPKTPIFRPD

SEQ ID NO: 21551 - protein, 146 aa, Homo sapiens
  Payload ID: 4342
  Gene Symbol: CHIC2
  Gene Name: cysteine-rich hydrophobic domain 2
  ENSP ID: ENSP00000425238
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRLCLHWRLSKRKCETNNMMEYVILIEFLPKTPIFRPD

SEQ ID NO: 21552 - protein, 446 aa, Homo sapiens
  Payload ID: 4343
  Gene Symbol: CRIPAK
  Gene Name: cysteine-rich PAK1 inhibitor
  Uniprot ID: Q8N1N5
  ENSP ID: ENSP00000323978
MHEPSLCANVECPPAHTCPCGVPACSCAHVECPPAHTCRCGVPACSHMPMWSARLLTRAHVECPPAHTRVHVECPPAHVPMWSAHLLTCADVECHLLTHVPMWSARLLTCPCGVPACSHVPMRSARLLTRAHAECPPAHTCPCGVPACSHVPMRSARLLTRADVECPPAHTCPCGVPACSHVPTWSARLITRAHVECSPAHTCRCGVPACSHVPMWSVRLLTRADAECPPAHTCRCGVPACSHVPMWSARLLTCRCGVPACSHVPMWSARLLTCRCGVPACSHVPMWSARLLTRAHVECPPAHTCRRGVPACSRAHMECPPAHTCHCGVPACSHTCRCGVPACSHVPMWSARLLTRAHVECPPAHTRAHVECPPAHTCPCGVPACSHTCPCGVPACSHKALAWWFCRFPVLPAESDAVTVHSTHGGFLIRFYVKDPFYISLHLEIT

SEQ ID NO: 21553 - protein, 101 aa, Homo sapiens
  Payload ID: 4344
  Gene Symbol: CRIPT
  Gene Name: cysteine-rich PDZ-binding protein
  Uniprot ID: Q9P021
  ENSP ID: ENSP00000238892
MVCEKCEKKLGTVITPDTWKDGARNTTESGGRKLNENKALTSKKARFDPYGKNKFSTCRICKSSVHQPGSHYCQGCAYKKGICAMCGKKVLDTKNYKQTSV

SEQ ID NO: 21554 - protein, 46 aa, Homo sapiens
  Payload ID: 4345
  Gene Symbol: AL928654.7
  Gene Name: Cysteine-rich protein 1
  ENSP ID: ENSP00000454458
  MOD_RES (1)..(1): Any amino acid
XKCGKTLTSGGHAEHEGKPYCNHPCYAAMFGPKGFGRGGAESHTFK

SEQ ID NO: 21555 - protein, 46 aa, Homo sapiens; identical to SEQ ID NO: 21554
  Payload ID: 4345
  Gene Symbol: AL928654.7
  Gene Name: Cysteine-rich protein 1
  ENSP ID: ENSP00000455328
  MOD_RES (1)..(1): Any amino acid

SEQ ID NO: 21556 - protein, 77 aa, Homo sapiens
  Payload ID: 4345
  Gene Symbol: AL928654.7
  Gene Name: Cysteine-rich protein 1
  ENSP ID: ENSP00000455329
MPKCPKCNKEVYFAERVTSLGKDWHRPCLKCEKCGKTLTSGGHAEHEGKPYCNHPCYAAMFGPKGFGRGGAESHTFK

SEQ ID NO: 21557 - protein, 46 aa, Homo sapiens; identical to SEQ ID NO: 21554
  Payload ID: 4345
  Gene Symbol: AL928654.7
  Gene Name: Cysteine-rich protein 1
  ENSP ID: ENSP00000456068
  MOD_RES (1)..(1): Any amino acid

SEQ ID NO: 21558 - protein, 49 aa, Homo sapiens
  Payload ID: 4345
  Gene Symbol: AL928654.7
  Gene Name: Cysteine-rich protein 1
  ENSP ID: ENSP00000456357
  MOD_RES (1)..(1): Any amino acid
XKCEKCGKTLTSGGHAEHEGKPYCNHPCYAAMFGPKGFGRGGAESHTFK

SEQ ID NO: 21559 - protein, 77 aa, Homo sapiens; identical to SEQ ID NO: 21556
  Payload ID: 4346
  Gene Symbol: CRIP1
  Gene Name: cysteine-rich protein 1 (intestinal)
  Uniprot ID: P50238
  ENSP ID: ENSP00000332449

SEQ ID NO: 21560 - protein, 77 aa, Homo sapiens; identical to SEQ ID NO: 21556
  Payload ID: 4346
  Gene Symbol: CRIP1
  Gene Name: cysteine-rich protein 1 (intestinal)
  Uniprot ID: P50238
  ENSP ID: ENSP00000376315

SEQ ID NO: 21561 - protein, 77 aa, Homo sapiens; identical to SEQ ID NO: 21556
  Payload ID: 4346
  Gene Symbol: CRIP1
  Gene Name: cysteine-rich protein 1 (intestinal)
  Uniprot ID: P50238
  ENSP ID: ENSP00000386340

SEQ ID NO: 21562 - protein, 208 aa, Homo sapiens
  Payload ID: 4347
  Gene Symbol: CRIP2
  Gene Name: cysteine-rich protein 2
  Uniprot ID: P52943
  ENSP ID: ENSP00000328521
MASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 21563 - protein, 282 aa, Homo sapiens
  Payload ID: 4347
  Gene Symbol: CRIP2
  Gene Name: cysteine-rich protein 2
  Uniprot ID: P52943
  ENSP ID: ENSP00000426119
MPPHHLLPWLAQVPSAEGELVRLVSRAGGRGACFWPAVTMEMAVAAGCVCKGGGCCHREPSQDHHESQEHRGPLVGSQTCLVHQAEGTAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 21564 - protein, 192 aa, Homo sapiens
  Payload ID: 4347
  Gene Symbol: CRIP2
  Gene Name: cysteine-rich protein 2
  ENSP ID: ENSP00000437723
  MOD_RES (1)..(1): Any amino acid
XEENGRRARADRAHRPWPPNAPSATRPCTSHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 21565 - protein, 104 aa, Homo sapiens
  Payload ID: 4347
  Gene Symbol: CRIP2
  Gene Name: cysteine-rich protein 2
  ENSP ID: ENSP00000446875
  MOD_RES (1)..(1): Any amino acid
XPGGERAEGAGRPGAPTMASKCPKCDKTVYFAEKVTSLGKDWHRPCLRCERCGKTLTPGGHAEHDGQPYCHKPCYGILFGPKGVNTGAVGSYIYDRDPEGKVQP

SEQ ID NO: 21566 - protein, 217 aa, Homo sapiens
  Payload ID: 4348
  Gene Symbol: CRIP3
  Gene Name: cysteine-rich protein 3
  Uniprot ID: Q6Q6R5
  ENSP ID: ENSP00000274990
MSWTCPRCQQPVFFAEKVSSLGKNWHRFCLKCERCHSILSPGGHAEHNGRPYCHKPCYGALFGPRGVNIGGVGSYLYNPPTPSPGCTTPLSPSSFSPPRPRTGLPQGKKSPPHMKTFTGETSLCPGCGEPVYFAEKVMSLGRNWHRPCLRCQRCHKTLTAGSHAEHDGVPYCHVPCYGYLFGPKGGQPHPRHWDGMYMPEVWHVHGLWVCVDNFPCG

SEQ ID NO: 21567 - protein, 204 aa, Homo sapiens
  Payload ID: 4348
  Gene Symbol: CRIP3
  Gene Name: cysteine-rich protein 3
  Uniprot ID: Q6Q6R5
  ENSP ID: ENSP00000361650
MSWTCPRCQQPVFFAEKVSSLGKNWHRFCLKCERCHSILSPGGHAEHNGRPYCHKPCYGALFGPRGVNIGGVGSYLYNPPTPSPGCTTPLSPSSFSPPRPRTGLPQGKKSPPHMKTFTGETSLCPGCGEPVYFAEKVMSLGRNWHRPCLRCQRCHKTLTAGSHAEHDGVPYCHVPCYGYLFGPKGVNIGDVGCYIYDPVKIKFK

SEQ ID NO: 21568 - protein, 38 aa, Homo sapiens
  Payload ID: 4348
  Gene Symbol: CRIP3
  Gene Name: cysteine-rich protein 3
  ENSP ID: ENSP00000397775
EPVYFAEKVMSLGRNWHRPCLRCQRCHKTLTAGSHAEV

SEQ ID NO: 21569 - protein, 110 aa, Homo sapiens
  Payload ID: 4348
  Gene Symbol: CRIP3
  Gene Name: cysteine-rich protein 3
  ENSP ID: ENSP00000414553
  MOD_RES (1)..(1): Any amino acid
XHKPCYGALFGPRGVNIGGVGSYLYNPPTPSPGCTTPLSPSSFSPPRPRTGLPQGKKTEKVMSLGRNWHRPCLRCQRCHKTLTAGSHAEHDGVPYCHVPCYGYLFGPKAL

SEQ ID NO: 21570 - protein, 178 aa, Homo sapiens
  Payload ID: 4349
  Gene Symbol: CRISP1
  Gene Name: cysteine-rich secretory protein 1
  Uniprot ID: P54107
  ENSP ID: ENSP00000331317
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHD

SEQ ID NO: 21571 - protein, 249 aa, Homo sapiens
  Payload ID: 4349
  Gene Symbol: CRISP1
  Gene Name: cysteine-rich secretory protein 1
  Uniprot ID: P54107
  ENSP ID: ENSP00000338276
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 21572 - protein, 178 aa, Homo sapiens; identical to SEQ ID NO: 21570
  Payload ID: 4349
  Gene Symbol: CRISP1
  Gene Name: cysteine-rich secretory protein 1
  Uniprot ID: P54107
  ENSP ID: ENSP00000425020

SEQ ID NO: 21573 - protein, 249 aa, Homo sapiens; identical to SEQ ID NO: 21571
  Payload ID: 4349
  Gene Symbol: CRISP1
  Gene Name: cysteine-rich secretory protein 1
  Uniprot ID: P54107
  ENSP ID: ENSP00000427589

SEQ ID NO: 21574 - protein, 243 aa, Homo sapiens
  Payload ID: 4350
  Gene Symbol: CRISP2
  Gene Name: cysteine-rich secretory protein 2
  Uniprot ID: P16562
  ENSP ID: ENSP00000339155
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 21575 - protein, 278 aa, Homo sapiens
  Payload ID: 4350
  Gene Symbol: CRISP2
  Gene Name: cysteine-rich secretory protein 2
  Uniprot ID: P16562
  ENSP ID: ENSP00000482890
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAMKTYLNKREGINVWKCFLRLRHFQLLRGEQLLTFSGNNMNRKNTPYQQGTPCAGCPDDCDKGLCTNSCQYQDLLSNCDSLKNTAGCEHELLKEKCKATCLCENKIY

SEQ ID NO: 21576 - protein, 243 aa, Homo sapiens; identical to SEQ ID NO: 21574
  Payload ID: 4350
  Gene Symbol: CRISP2
  Gene Name: cysteine-rich secretory protein 2
  Uniprot ID: P16562
  ENSP ID: ENSP00000484609

SEQ ID NO: 21577 - protein, 258 aa, Homo sapiens
  Payload ID: 4351
  Gene Symbol: CRISP3
  Gene Name: cysteine-rich secretory protein 3
  Uniprot ID: P54108
  ENSP ID: ENSP00000263045
MKQILHPALETTAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 21578 - protein, 191 aa, Homo sapiens
  Payload ID: 4351
  Gene Symbol: CRISP3
  Gene Name: cysteine-rich secretory protein 3
  ENSP ID: ENSP00000346636
MKQILHPALETTDPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYV

SEQ ID NO: 21579 - protein, 276 aa, Homo sapiens
  Payload ID: 4351
  Gene Symbol: CRISP3
  Gene Name: cysteine-rich secretory protein 3
  ENSP ID: ENSP00000360201
MKQILHPALETTACTNHFNADPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 21580 - protein, 268 aa, Homo sapiens
  Payload ID: 4351
  Gene Symbol: CRISP3
  Gene Name: cysteine-rich secretory protein 3
  Uniprot ID: P54108
  ENSP ID: ENSP00000389026
MKQILHPALETTDPCSTGFVFPAMTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 21581 - protein, 500 aa, Homo sapiens
  Payload ID: 4352
  Gene Symbol: CRISPLD1
  Gene Name: cysteine-rich secretory protein LCCL domain containing 1
  Uniprot ID: Q9H336
  ENSP ID: ENSP00000262207
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 21582 - protein, 314 aa, Homo sapiens
  Payload ID: 4352
  Gene Symbol: CRISPLD1
  Gene Name: cysteine-rich secretory protein LCCL domain containing 1
  Uniprot ID: Q9H336
  ENSP ID: ENSP00000429746
MNMNATHIVHSGVLALYVHIIHRGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 21583 - protein, 312 aa, Homo sapiens
  Payload ID: 4352
  Gene Symbol: CRISPLD1
  Gene Name: cysteine-rich secretory protein LCCL domain containing 1
  ENSP ID: ENSP00000430105
MNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 21584 - protein, 105 aa, Homo sapiens
  Payload ID: 4352
  Gene Symbol: CRISPLD1
  Gene Name: cysteine-rich secretory protein LCCL domain containing 1
  ENSP ID: ENSP00000430504
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLW

SEQ ID NO: 21585 - protein, 497 aa, Homo sapiens
  Payload ID: 4353
  Gene Symbol: CRISPLD2
  Gene Name: cysteine-rich secretory protein LCCL domain containing 2
  Uniprot ID: Q9H0B8
  ENSP ID: ENSP00000262424
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 21586 - protein, 120 aa, Homo sapiens
  Payload ID: 4353
  Gene Symbol: CRISPLD2
  Gene Name: cysteine-rich secretory protein LCCL domain containing 2
  Uniprot ID: Q9H0B8
  ENSP ID: ENSP00000454858
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGR

SEQ ID NO: 21587 - protein, 18 aa, Homo sapiens
  Payload ID: 4353
  Gene Symbol: CRISPLD2
  Gene Name: cysteine-rich secretory protein LCCL domain containing 2
  ENSP ID: ENSP00000456554
MSCVLGGVIPLGLLFLVC

SEQ ID NO: 21588 - protein, 209 aa, Homo sapiens
  Payload ID: 4353
  Gene Symbol: CRISPLD2
  Gene Name: cysteine-rich secretory protein LCCL domain containing 2
  ENSP ID: ENSP00000456952
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHG

SEQ ID NO: 21589 - protein, 496 aa, Homo sapiens
  Payload ID: 4353
  Gene Symbol: CRISPLD2
  Gene Name: cysteine-rich secretory protein LCCL domain containing 2
  ENSP ID: ENSP00000457183
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYRETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 21590 - protein, 111 aa, Homo sapiens
  Payload ID: 4353
  Gene Symbol: CRISPLD2
  Gene Name: cysteine-rich secretory protein LCCL domain containing 2
  ENSP ID: ENSP00000457259
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPR

SEQ ID NO: 21591 - protein, 449 aa, Homo sapiens
  Payload ID: 4353
  Gene Symbol: CRISPLD2
  Gene Name: cysteine-rich secretory protein LCCL domain containing 2
  Uniprot ID: Q9H0B8
  ENSP ID: ENSP00000457655
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADVSRMHFQQLSRKAC

SEQ ID NO: 21592 - protein, 43 aa, Homo sapiens
  Payload ID: 4353
  Gene Symbol: CRISPLD2
  Gene Name: cysteine-rich secretory protein LCCL domain containing 2
  ENSP ID: ENSP00000463171
  MOD_RES (1)..(1): Any amino acid
XKTAVHAGVISNESGGDVDVMPVDKKKTYVGSLRNGVQSERNM

SEQ ID NO: 21593 - protein, 184 aa, Homo sapiens
  Payload ID: 4354
  Gene Symbol: CYSRT1
  Gene Name: cysteine-rich tail protein 1
  ENSP ID: ENSP00000386453
MAPPLPRREKAAASRSTQALGPRAQKTERTDCRVATTGWTMDPQEMVVKNPYAHISIPRAHLRPDLGQQLEVASTCSSSSEMQPLPVGPCAPEPTHLLQPTEVPGPKGAKGNQGAAPIQNQQAWQQPGNPYSSSQRQAGLTYAGPPPAGRGDDIAHHCCCCPCCHCCHCPPFCRCHSCCCCVIS

SEQ ID NO: 21594 - protein, 97 aa, Homo sapiens
  Payload ID: 4355
  Gene Symbol: CYSTM1
  Gene Name: cysteine-rich transmembrane module containing 1
  Uniprot ID: Q9H1C7
  ENSP ID: ENSP00000261811
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 21595 - protein, 422 aa, Homo sapiens
  Payload ID: 4356
  Gene Symbol: CRELD1
  Gene Name: cysteine-rich with EGF-like domains 1
  Uniprot ID: Q96HD1
  ENSP ID: ENSP00000321856
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPGAFPILTDLTPETTRRWKLGSHPHSTYVKMKMQRDEATFPGLYGKQVAKLGSQSRQSDRGTRLIHSQQASSQR

SEQ ID NO: 21596 - protein, 420 aa, Homo sapiens
  Payload ID: 4356
  Gene Symbol: CRELD1
  Gene Name: cysteine-rich with EGF-like domains 1
  Uniprot ID: Q96HD1
  ENSP ID: ENSP00000373322
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 21597 - protein, 420 aa, Homo sapiens; identical to SEQ ID NO: 21596
  Payload ID: 4356
  Gene Symbol: CRELD1
  Gene Name: cysteine-rich with EGF-like domains 1
  Uniprot ID: Q96HD1
  ENSP ID: ENSP00000380355

SEQ ID NO: 21598 - protein, 420 aa, Homo sapiens; identical to SEQ ID NO: 21596
  Payload ID: 4356
  Gene Symbol: CRELD1
  Gene Name: cysteine-rich with EGF-like domains 1
  Uniprot ID: Q96HD1
  ENSP ID: ENSP00000393643

SEQ ID NO: 21599 - protein, 100 aa, Homo sapiens
  Payload ID: 4356
  Gene Symbol: CRELD1
  Gene Name: cysteine-rich with EGF-like domains 1
  ENSP ID: ENSP00000406556
  MOD_RES (1)..(1): Any amino acid
XPAHLSADIDECGTEGANCGADQFCVNTEGSYECRDCAKACLGCMGAGPGRCKKCSPGYQQMWMSVRQRCVRERTSSVKTPRAVIAASVPRATSRWKASV

SEQ ID NO: 21600 - protein, 101 aa, Homo sapiens
  Payload ID: 4356
  Gene Symbol: CRELD1
  Gene Name: cysteine-rich with EGF-like domains 1
  ENSP ID: ENSP00000411021
MAPWPPKGLVPAMLWGLSLFLNLPGPIWLQPSPPPQSSPPPQPHPCHTCRGLVDSFNKGLERTIRDNFGGGNTAWEEENLSKYKDSLSWGNREALRWLRAV

SEQ ID NO: 21601 - protein, 353 aa, Homo sapiens
  Payload ID: 4357
  Gene Symbol: CRELD2
  Gene Name: cysteine-rich with EGF-like domains 2
  Uniprot ID: Q6UXH1
  ENSP ID: ENSP00000332223
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 21602 - protein, 402 aa, Homo sapiens
  Payload ID: 4357
  Gene Symbol: CRELD2
  Gene Name: cysteine-rich with EGF-like domains 2
  Uniprot ID: Q6UXH1
  ENSP ID: ENSP00000383938
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTVRTGLSDSYPPCCLSLGCWRGVGHAWIRGRNTHTQPGYSSRVWIAAFSPACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 21603 - protein, 325 aa, Homo sapiens
  Payload ID: 4357
  Gene Symbol: CRELD2
  Gene Name: cysteine-rich with EGF-like domains 2
  Uniprot ID: Q6UXH1
  ENSP ID: ENSP00000384111
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 21604 - protein, 321 aa, Homo sapiens
  Payload ID: 4357
  Gene Symbol: CRELD2
  Gene Name: cysteine-rich with EGF-like domains 2
  Uniprot ID: Q6UXH1
  ENSP ID: ENSP00000386034
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEDVDECSLAEKTCVRKNENCYNTPGSYVCVCPDGFEETEDACVPPAEAEATEGESPTQLPSREDL

SEQ ID NO: 21605 - protein, 229 aa, Homo sapiens
  Payload ID: 4357
  Gene Symbol: CRELD2
  Gene Name: cysteine-rich with EGF-like domains 2
  ENSP ID: ENSP00000387769
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACV

SEQ ID NO: 21606 - protein, 381 aa, Homo sapiens [sequence omitted]

SEQ ID NO: 21607 - protein, 379 aa, Homo sapiens
  Payload ID: 4358
  Gene Symbol: CYR61
  Gene Name: cysteine-rich, angiogenic inducer, 61
  ENSP ID: ENSP00000479537
MSSRIARALALVVTLLHLTRLALSTCPAACHCPLEAPKCAPGVGLVRDGCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVTGQCCEEWVCDEDSIKDPMEDQDGLLGKELGFDASEVELTRNNELIAVGKGSSLKRLPVFGMEPRILYNPLQGQKCIVQTTSWSQCSKTCGTGISTRVTNDNPECRLVKETRICEVRPCGQPVYSSLKKGKKCSKTKKSPEPVRFTYAGCLSVKKYRPKYCGSCVDGRCCTPQLTRCEDAVPLRRWGDIFQERHDDPVKCNYNCPHANEAAFPFYRLFNDIHKFRD

SEQ ID NO: 21608 - protein, 123 aa, Homo sapiens
  Payload ID: 4359
  Gene Symbol: CDPF1
  Gene Name: cysteine-rich, DPF motif domain containing 1
  Uniprot ID: Q6NVV7
  ENSP ID: ENSP00000325301
MASHVECRPLGVFECELCTLTAPYSYVGQKPPNTQSMVLLEESYVMKDPFTSDKDRFLVLGSCCSLCSRLVCVGPECSLFYSKRFCLPCVRENINAFPQEIRQDLEKRKAPSKRTPSQPGSRT

SEQ ID NO: 21609 - protein, 89 aa, Homo sapiens
  Payload ID: 4359
  Gene Symbol: CDPF1
  Gene Name: cysteine-rich, DPF motif domain containing 1
  ENSP ID: ENSP00000370425
MASHVECRPLGVFECELCTLTAPYSYVGQKPPNTQSMVLLEESYVMKDPFTSDKDRFLVLGSCCSLCSRLVCVGPMFLEGSPGEGTVLS

SEQ ID NO: 21610 - protein, 118 aa, Homo sapiens
  Payload ID: 4359
  Gene Symbol: CDPF1
  Gene Name: cysteine-rich, DPF motif domain containing 1
  ENSP ID: ENSP00000384451
MASHVECRPLGVFECELCTLTAPYSYVGQKPPNTQSMVLLEESYVMKDPFTSDKDRFLVLGSCCSLCSRLECSLFYSKRFCLPCVRENINAFPQEIRQDLEKRKAPSKRTPSQPGSRT

SEQ ID NO: 21611 - protein, 115 aa, Homo sapiens
  Payload ID: 4359
  Gene Symbol: CDPF1
  Gene Name: cysteine-rich, DPF motif domain containing 1
  ENSP ID: ENSP00000385460
MASHVECRPLGVFECELCTLTAPYSYVGQKPPNTQSMVLLEESYVMKDPFTSDKDRFLVLGSCCSLCSRLVCVGPVDVLGGISRRRDCPFMSTCCVPGPVLGTCFTAEASFSPAP

SEQ ID NO: 21612 - protein, 589 aa, Homo sapiens
  Payload ID: 4360
  Gene Symbol: CSRNP1
  Gene Name: cysteine-serine-rich nuclear protein 1
  Uniprot ID: Q96S65
  ENSP ID: ENSP00000273153
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 21613 - protein, 589 aa, Homo sapiens; identical to SEQ ID NO: 21612
  Payload ID: 4360
  Gene Symbol: CSRNP1
  Gene Name: cysteine-serine-rich nuclear protein 1
  Uniprot ID: Q96S65
  ENSP ID: ENSP00000422532

SEQ ID NO: 21614 - protein, 543 aa, Homo sapiens
  Payload ID: 4361
  Gene Symbol: CSRNP2
  Gene Name: cysteine-serine-rich nuclear protein 2
  Uniprot ID: Q9H175
  ENSP ID: ENSP00000228515
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQEVNHREILREHLKEEKLHAKKMKLTKNGTVESVEADGLTLDDVSDEDIDVENVEVDDYFFLQPLPTKRRRALLRASGVHRIDAEEKQELRAIRLSREECGCDCRLYCDPEACACSQAGIKCQVDRMSFPCGCSRDGCGNMAGRIEFNPIRVRTHYLHTIMKLELESKRQVSRPAAPDEEPSPTASCSLTGAQGSETQDFQEFIAENETAVMHLQSAEELERLKAEEDSSGSSASLDSSIESLGVCILEEPLAVPEELCPGLTAPILIQAQLPPGSSVLCFTENSDHPTASTVNSPSYLNSGPLVYYQVEQRPVLGVKGEPGTEEGSASFPKEKDLNVFSLPVTSLVACSSTDPAALCKSEVGKTPTLEALLPEDCNPEEPENEDFHPSWSPSSLPFRTDNEEGCGMVKTSQQNEDRPPEDSSLELPLAV

SEQ ID NO: 21615 - protein, 86 aa, Homo sapiens
  Payload ID: 4361
  Gene Symbol: CSRNP2
  Gene Name: cysteine-serine-rich nuclear protein 2
  ENSP ID: ENSP00000447065
MDAFTGSGLKRKFDDVDVGSSVSNSDDEISSSDSADSCDSLNPPTTASFTPTSILKRQKQLRRKNVRFDQVTVYYFARRQGFTSVP

SEQ ID NO: 21616 - protein, 114 aa, Homo sapiens
  Payload ID: 4361
  Gene Symbol: CSRNP2
  Gene Name: cysteine-serine-rich nuclear protein 2
  ENSP ID: ENSP00000447657
MDAFTGSGLKRKFDDVDVGSSVSNSDDEISSSDSADSCDSLNPPTTASFTPTSILKRQKQLRRKNVRFDQVTVYYFARRQGFTSVPSQGGSSLGMAQRHNSVRSYTLCEFAQEQ

SEQ ID NO: 21617 - protein, 66 aa, Homo sapiens
  Payload ID: 4361
  Gene Symbol: CSRNP2
  Gene Name: cysteine-serine-rich nuclear protein 2
  ENSP ID: ENSP00000447983
MAQRHNSVRSYTLCEFAQEQEVNHREILREHLKEEKLHAKKMKLTKNGTVESVEADGLTLDDVSDE

SEQ ID NO: 21618 - protein, 58 aa, Homo sapiens
  Payload ID: 4361
  Gene Symbol: CSRNP2
  Gene Name: cysteine-serine-rich nuclear protein 2
  ENSP ID: ENSP00000449152
MDAFTGSGLKRKFDDVDVGSSVSNSDDEISSSDSADSCDSLNPPTTASFTPTSILKRQ

SEQ ID NO: 21619 - protein, 585 aa, Homo sapiens
  Payload ID: 4362
  Gene Symbol: CSRNP3
  Gene Name: cysteine-serine-rich nuclear protein 3
  Uniprot ID: Q8WYN3
  ENSP ID: ENSP00000318258
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 21620 - protein, 585 aa, Homo sapiens; identical to SEQ ID NO: 21619
  Payload ID: 4362
  Gene Symbol: CSRNP3
  Gene Name: cysteine-serine-rich nuclear protein 3
  Uniprot ID: Q8WYN3
  ENSP ID: ENSP00000344042

SEQ ID NO: 21621 - protein, 138 aa, Homo sapiens
  Payload ID: 4362
  Gene Symbol: CSRNP3
  Gene Name: cysteine-serine-rich nuclear protein 3
  ENSP ID: ENSP00000386278
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMT

SEQ ID NO: 21622 - protein, 617 aa, Homo sapiens
  Payload ID: 4362
  Gene Symbol: CSRNP3
  Gene Name: cysteine-serine-rich nuclear protein 3
  ENSP ID: ENSP00000387195
MKCALFLRVKILQRVCRSRYIVHAGTCDSTAAMSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 21623 - protein, 437 aa, Homo sapiens
  Payload ID: 4362
  Gene Symbol: CSRNP3
  Gene Name: cysteine-serine-rich nuclear protein 3
  ENSP ID: ENSP00000412081
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYY

SEQ ID NO: 21624 - protein, 337 aa, Homo sapiens
  Payload ID: 4363
  Gene Symbol: CYSLTR1
  Gene Name: cysteinyl leukotriene receptor 1
  Uniprot ID: Q9Y271
  ENSP ID: ENSP00000362401
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 21625 - protein, 337 aa, Homo sapiens; identical to SEQ ID NO: 21624
  Payload ID: 4363
  Gene Symbol: CYSLTR1
  Gene Name: cysteinyl leukotriene receptor 1
  Uniprot ID: Q9Y271
  ENSP ID: ENSP00000478492

SEQ ID NO: 21626 - protein, 346 aa, Homo sapiens
  Payload ID: 4364
  Gene Symbol: CYSLTR2
  Gene Name: cysteinyl leukotriene receptor 2
  Uniprot ID: Q9NS75
  ENSP ID: ENSP00000282018
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 21627 - protein, 346 aa, Homo sapiens; identical to SEQ ID NO: 21626
  Payload ID: 4364
  Gene Symbol: CYSLTR2
  Gene Name: cysteinyl leukotriene receptor 2
  Uniprot ID: Q9NS75
  ENSP ID: ENSP00000477930

SEQ ID NO: 21628 - protein, 14 aa, Homo sapiens
  Payload ID: 4364
  Gene Symbol: CYSLTR2
  Gene Name: cysteinyl leukotriene receptor 2
  ENSP ID: ENSP00000479446
MERKFMSLQPSISV

SEQ ID NO: 21629 - protein, 14 aa, Homo sapiens
  Payload ID: 4364
  Gene Symbol: CYSLTR2
  Gene Name: cysteinyl leukotriene receptor 2
  ENSP ID: ENSP00000482031
MERKFMSLQPSISV

SEQ ID NO: 21630 - protein, 14 aa, Homo sapiens
  Payload ID: 4364
  Gene Symbol: CYSLTR2
  Gene Name: cysteinyl leukotriene receptor 2
  ENSP ID: ENSP00000482041
MERKFMSLQPSISV

SEQ ID NO: 21631 - protein, 726 aa, Homo sapiens
  Payload ID: 4365
  Gene Symbol: CARS
  Gene Name: cysteinyl-tRNA synthetase
  Uniprot ID: P49589
  ENSP ID: ENSP00000278224
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 21632 - protein, 831 aa, Homo sapiens
  Payload ID: 4365
  Gene Symbol: CARS
  Gene Name: cysteinyl-tRNA synthetase
  Uniprot ID: P49589
  ENSP ID: ENSP00000369897
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 21633 - protein, 748 aa, Homo sapiens
  Payload ID: 4365
  Gene Symbol: CARS
  Gene Name: cysteinyl-tRNA synthetase
  Uniprot ID: P49589
  ENSP ID: ENSP00000380300
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 21634 - protein, 45 aa, Homo sapiens
  Payload ID: 4365
  Gene Symbol: CARS
  Gene Name: cysteinyl-tRNA synthetase
  ENSP ID: ENSP00000408802
MADSSGQQGKGRRVQPQWSPPAGTQPCRLHLYNSLTRNKCFLHFL

SEQ ID NO: 21635 - protein, 128 aa, Homo sapiens
  Payload ID: 4365
  Gene Symbol: CARS
  Gene Name: cysteinyl-tRNA synthetase
  ENSP ID: ENSP00000431368
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKCFLHFL

SEQ ID NO: 21636 - protein, 739 aa, Homo sapiens
  Payload ID: 4365
  Gene Symbol: CARS
  Gene Name: cysteinyl-tRNA synthetase
  ENSP ID: ENSP00000432619
MEPTSGPFRTDLGYHLVGCSSGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 21637 - protein, 76 aa, Homo sapiens
  Payload ID: 4365
  Gene Symbol: CARS
  Gene Name: cysteinyl-tRNA synthetase
  ENSP ID: ENSP00000434184
MADSSGQQGKGRRVQPQWSPPAGTQPCRLHLYNSLTRNKEVFIPQDGKKVTWYCCGPTVYDASHMGHASSRGVPRC

SEQ ID NO: 21638 - protein, 831 aa, Homo sapiens; identical to SEQ ID NO: 21632
  Payload ID: 4365
  Gene Symbol: CARS
  Gene Name: cysteinyl-tRNA synthetase
  Uniprot ID: P49589
  ENSP ID: ENSP00000482336

SEQ ID NO: 21639 - protein, 76 aa, Homo sapiens; identical to SEQ ID NO: 21637
  Payload ID: 4365
  Gene Symbol: CARS
  Gene Name: cysteinyl-tRNA synthetase
  ENSP ID: ENSP00000486161

SEQ ID NO: 21640 - protein, 726 aa, Homo sapiens; identical to SEQ ID NO: 21631
  Payload ID: 4365
  Gene Symbol: CARS
  Gene Name: cysteinyl-tRNA synthetase
  Uniprot ID: P49589
  ENSP ID: ENSP00000487923

SEQ ID NO: 21641 - protein, 739 aa, Homo sapiens; identical to SEQ ID NO: 21636
  Payload ID: 4365
  Gene Symbol: CARS
  Gene Name: cysteinyl-tRNA synthetase
  ENSP ID: ENSP00000488062

SEQ ID NO: 21642 - protein, 45 aa, Homo sapiens; identical to SEQ ID NO: 21634
  Payload ID: 4365
  Gene Symbol: CARS
  Gene Name: cysteinyl-tRNA synthetase
  ENSP ID: ENSP00000488476

SEQ ID NO: 21643 - protein, 748 aa, Homo sapiens; identical to SEQ ID NO: 21633
  Payload ID: 4365
  Gene Symbol: CARS
  Gene Name: cysteinyl-tRNA synthetase
  Uniprot ID: P49589
  ENSP ID: ENSP00000488657

SEQ ID NO: 21644 - protein, 128 aa, Homo sapiens; identical to SEQ ID NO: 21635
  Payload ID: 4365
  Gene Symbol: CARS
  Gene Name: cysteinyl-tRNA synthetase
  ENSP ID: ENSP00000488737

SEQ ID NO: 21645 - protein, 564 aa, Homo sapiens
  Payload ID: 4366
  Gene Symbol: CARS2
  Gene Name: cysteinyl-tRNA synthetase 2, mitochondrial (putative)
  Uniprot ID: Q9HA77
  ENSP ID: ENSP00000257347
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAKGNVYFDLKSRGDKYGKLVGVVPGPVGEPADSDKRHASDFALWKAAKPQEVFWASPWGPGRPGWHIECSAIASMVFGSQLDIHSGGIDLAFPHHENEIAQCEVFHQCEQWGNYFLHSGHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 21646 - protein, 154 aa, Homo sapiens
  Payload ID: 4366
  Gene Symbol: CARS2
  Gene Name: cysteinyl-tRNA synthetase 2, mitochondrial (putative)
  ENSP ID: ENSP00000437962
MLRTTRGPGLGPPLLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANERVLLCRPGWSAVAPSWLTATSAS

SEQ ID NO: 21647 - protein, 176 aa, Homo sapiens
  Payload ID: 4366
  Gene Symbol: CARS2
  Gene Name: cysteinyl-tRNA synthetase 2, mitochondrial (putative)
  ENSP ID: ENSP00000438267
  MOD_RES (1)..(1): Any amino acid
XHLHAKGKEEKMSKSLKNYITIKDFLKTFSPDVFRFFCLRSSYRSAIDYSDSAMLQAQQLLLGLGSFLEDARAYMKGQLACGSVREAMLWERLSSTKRAVKAALADDFDTPRVVDAILGLAHHGNGQLRASLKEPEGPRSPAVFGAIISYFEQFFETVGISLANQQLANSRAQNQR

SEQ ID NO: 21648 - protein, 119 aa, Homo sapiens
  Payload ID: 4366
  Gene Symbol: CARS2
  Gene Name: cysteinyl-tRNA synthetase 2, mitochondrial (putative)
  ENSP ID: ENSP00000440420
  MOD_RES (1)..(1): Any amino acid
XLQAALGLGRAGWHWPAGRAASGGRGRAWLQPTGRETGVQVYNSLTGRKEPLIVAHAEAASWYSCGPTVYDHAHLGHACSYVRFDIIRRILTKVFGCSIVMVMGITDVDDKIIKRANEA

SEQ ID NO: 21649 - protein, 92 aa, Homo sapiens
  Payload ID: 4366
  Gene Symbol: CARS2
  Gene Name: cysteinyl-tRNA synthetase 2, mitochondrial (putative)
  ENSP ID: ENSP00000443027
  MOD_RES (1)..(1): Any amino acid
XWGPGRPGWHIECSAIASMVFGSQLDIHSGGIDLAFPHHENEIAQCEVFHQCEQWGNYFLHSGHLHAKGKEEKMSKSLKNYITIKAQSWLDP

SEQ ID NO: 21650 - protein, 181 aa, Homo sapiens
  Payload ID: 4366
  Gene Symbol: CARS2
  Gene Name: cysteinyl-tRNA synthetase 2, mitochondrial (putative)
  ENSP ID: ENSP00000444655
MEGAVLEAGGARCFCRFGCELSKYENPGYSSPRSDYFKNYMIIITQNRMSFLANMFHTMDFNFVSRYSCGPTVYDHAHLGHACSYVRFDIIRRILTKVFGCSIVMVMGITDVDDKIIKRANEMNISPASLASLYEEDFKQDMAALKVLPPTVYLRVTENIPQIISFIEGIIARGNAYSTAK

SEQ ID NO: 21651 - protein, 90 aa, Homo sapiens
  Payload ID: 4366
  Gene Symbol: CARS2
  Gene Name: cysteinyl-tRNA synthetase 2, mitochondrial (putative)
  ENSP ID: ENSP00000480523
  MOD_RES (1)..(1): Any amino acid
XMLWERLSSTKRAVKAALADDFDTPRVVDAILGLAHHGNGQLRASLKEPEGPRSPAVFGAIISYFEQFFETVGISLANQQLANSRAQNQR

SEQ ID NO: 21652 - protein, 1480 aa, Homo sapiens
  Payload ID: 4367
  Gene Symbol: CFTR
  Gene Name: cystic fibrosis transmembrane conductance regulator (ATP-binding cassette sub-family C, member 7)
  Uniprot ID: P13569
  ENSP ID: ENSP00000003084
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 21653 - protein, 1438 aa, Homo sapiens
  Payload ID: 4367
  Gene Symbol: CFTR
  Gene Name: cystic fibrosis transmembrane conductance regulator (ATP-binding cassette sub-family C, member 7)
  ENSP ID: ENSP00000389119
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALK

SEQ ID NO: 21654 - protein, 36 aa, Homo sapiens
  Payload ID: 4367
  Gene Symbol: CFTR
  Gene Name: cystic fibrosis transmembrane conductance regulator (ATP-binding cassette sub-family C, member 7)
  ENSP ID: ENSP00000417012
MFYGIFLYLGEVTKAVQPLLLGRIIASYDPDNKEER

SEQ ID NO: 21655 - protein, 190 aa, Homo sapiens
  Payload ID: 4367
  Gene Symbol: CFTR
  Gene Name: cystic fibrosis transmembrane conductance regulator (ATP-binding cassette sub-family C, member 7)
  ENSP ID: ENSP00000419254
  MOD_RES (1)..(1): Any amino acid
XKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVRFEHCLLC

SEQ ID NO: 21656 - protein, 156 aa, Homo sapiens
  Payload ID: 4367
  Gene Symbol: CFTR
  Gene Name: cystic fibrosis transmembrane conductance regulator (ATP-binding cassette sub-family C, member 7)
  ENSP ID: ENSP00000470177
  MOD_RES (1)..(1): Any amino acid
XVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLIMMVAGPLFNGGIASLLAMKEKVISTNPGNSYL

SEQ ID NO: 21657 - protein, 158 aa, Homo sapiens
  Payload ID: 4368
  Gene Symbol: CYS1
  Gene Name: cystin 1
  Uniprot ID: Q717R9
  ENSP ID: ENSP00000371234
MGSGSSRSSRTLRRRRSPESLPAGPGAAALEGGTRRRVPVAAAEVPGAAAEEAPGRDPSPVAPPDGRDETLRLLDELLAESAAWGPPEPAPRRPARLRPTAVAGSAVCAEQSTEGHPGSGNVSEAPGSGRKKPERPAAISYDHSEEGLMASIEREYCR

SEQ ID NO: 21658 - protein, 367 aa, Homo sapiens
  Payload ID: 4369
  Gene Symbol: CTNS
  Gene Name: cystinosin, lysosomal cystine transporter
  Uniprot ID: O60931
  ENSP ID: ENSP00000046640
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 21659 - protein, 400 aa, Homo sapiens
  Payload ID: 4369
  Gene Symbol: CTNS
  Gene Name: cystinosin, lysosomal cystine transporter
  Uniprot ID: O60931
  ENSP ID: ENSP00000371294
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGLQAARTGSGSRLRQDWAPSLQPKALPQTTSVSASSLKG

SEQ ID NO: 21660 - protein, 122 aa, Homo sapiens
  Payload ID: 4369
  Gene Symbol: CTNS
  Gene Name: cystinosin, lysosomal cystine transporter
  ENSP ID: ENSP00000382245
MIRNWLTIFILFPLKLVEKCESSVSLTVPPVVKLENGSSTNVSLTLRPPLNATLVITFEITFRSKNITILELPDELVEAGGEECRDEISSHEAHQDGLQISSEPPRKQTGVKHDQSPACGNL

SEQ ID NO: 21661 - protein, 75 aa, Homo sapiens
  Payload ID: 4369
  Gene Symbol: CTNS
  Gene Name: cystinosin, lysosomal cystine transporter
  ENSP ID: ENSP00000408652
MIRNWLTIFILFPLKLVEKCESSVSLTVPPVVKLENGSSTNVSLTLRPPLNATLVITFEITFRSKNITILELPDE

SEQ ID NO: 21662 - protein, 162 aa, Homo sapiens
  Payload ID: 4369
  Gene Symbol: CTNS
  Gene Name: cystinosin, lysosomal cystine transporter
  ENSP ID: ENSP00000458457
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDF

SEQ ID NO: 21663 - protein, 28 aa, Homo sapiens
  Payload ID: 4369
  Gene Symbol: CTNS
  Gene Name: cystinosin, lysosomal cystine transporter
  ENSP ID: ENSP00000458912
MNWRRKSVIGLSFDFVALNLTGFVAYSV

SEQ ID NO: 21664 - protein, 53 aa, Homo sapiens
  Payload ID: 4369
  Gene Symbol: CTNS
  Gene Name: cystinosin, lysosomal cystine transporter
  ENSP ID: ENSP00000461056
MIRNWLTIFILFPLKLVEKCESSVSLTVPPVVKLENGSSTNVSLTLRLWCLLE

SEQ ID NO: 21665 - protein, 20 aa, Homo sapiens
  Payload ID: 4369
  Gene Symbol: CTNS
  Gene Name: cystinosin, lysosomal cystine transporter
  ENSP ID: ENSP00000461118
MNWRRKSVIGLSFDFVALNL

SEQ ID NO: 21666 - protein, 514 aa, Homo sapiens
  Payload ID: 4370
  Gene Symbol: CDADC1
  Gene Name: cytidine and dCMP deaminase domain containing 1
  Uniprot ID: Q9BWV3
  ENSP ID: ENSP00000251108
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 21667 - protein, 97 aa, Homo sapiens
  Payload ID: 4370
  Gene Symbol: CDADC1
  Gene Name: cytidine and dCMP deaminase domain containing 1
  ENSP ID: ENSP00000389571
  MOD_RES (1)..(1): Any amino acid
XGQMQNLESARAGRSVSTQTGSMTGQIPRLSKVNLFTLLSLWMELFPAEAQRQKSQKNEEGKHGPLGDNEERTRVSTDKRQDYWKQLRCLDERFTIT

SEQ ID NO: 21668 - protein, 153 aa, Homo sapiens
  Payload ID: 4370
  Gene Symbol: CDADC1
  Gene Name: cytidine and dCMP deaminase domain containing 1
  ENSP ID: ENSP00000434135
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNGLLEAAKMPR

SEQ ID NO: 21669 - protein, 102 aa, Homo sapiens
  Payload ID: 4370
  Gene Symbol: CDADC1
  Gene Name: cytidine and dCMP deaminase domain containing 1
  ENSP ID: ENSP00000434986
MKEAGQMQNLESARAGRSVSTQTGSMTGQIPRLSKVNLFTLLSLWMELFPAEAQRQKSQKNEEGKHGPLGDNEERTRVSTDKRQKTMFCLFENDCKWITGSS

SEQ ID NO: 21670 - protein, 146 aa, Homo sapiens [sequence omitted]

SEQ ID NO: 21671 - protein, 169 aa, Homo sapiens
  Payload ID: 4372
  Gene Symbol: CMPK1
  Gene Name: cytidine monophosphate (UMP-CMP) kinase 1, cytosolic
  ENSP ID: ENSP00000360937
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNENSDLPSVNKANY

SEQ ID NO: 21672 - protein, 228 aa, Homo sapiens
  Payload ID: 4372
  Gene Symbol: CMPK1
  Gene Name: cytidine monophosphate (UMP-CMP) kinase 1, cytosolic
  Uniprot ID: P30085
  ENSP ID: ENSP00000360939
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 21673 - protein, 179 aa, Homo sapiens
  Payload ID: 4372
  Gene Symbol: CMPK1
  Gene Name: cytidine monophosphate (UMP-CMP) kinase 1, cytosolic
  Uniprot ID: P30085
  ENSP ID: ENSP00000398192
MLSRCRSGLLHVLGLSFLLQTRRPILLCSPRLMKPLVVFVLGGPGAGKGTQCARIVEEMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 21674 - protein, 58 aa, Homo sapiens
  Payload ID: 4372
  Gene Symbol: CMPK1
  Gene Name: cytidine monophosphate (UMP-CMP) kinase 1, cytosolic
  ENSP ID: ENSP00000433782
MLSRCRSGLLHVLGLSFLLQTRRPILLCSPRLMKPLVVFVLGGPGAGKGTQCARIVEG

SEQ ID NO: 21675 - protein, 449 aa, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENSP ID: ENSP00000256722
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQKVEMSYQRMENPGCHVVDASPSREKVLQTVLSLIQNSFSEP

SEQ ID NO: 21676 - protein, 409 aa, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENSP ID: ENSP00000384915
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVFRQK

SEQ ID NO: 21677 - protein, 366 aa, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENSP ID: ENSP00000396385
MAFARRLLRGPLSGPLLGRRGVCAGAMAPPRRFVLELPDCTLAHFALGADAPGDADAPDPRLAALLGPPERSYSLCVPVTPDAGCGARVRAARLHQRLLHQLRRGPFQRCQLLRLLCYCPGGQAGGAQQGFLLRDPLDDPDTRQALLELLGACQEAPRPHLGEFEADPRGQLWQRLWEVQDGRRLQVGCAQVVPVPEPPLHPVVPDLPSSVVFPDREAARAVLEECTSFIPEARAVLDLVDQCPKQIQKGKFQVVAIEGLDATGKTTVTQSVADSLKAVLLKSPPSCIGQWRKIFDDEPTIIRRAFYSLGNYIVASEIAKESAKSPVIVDRSQLGGTLYHPSLHLLGSEVCGTGILDSSHSSQGLE

SEQ ID NO: 21678 - protein, 434 aa, Homo sapiens
  Payload ID: 4374
  Gene Symbol: CMAS
  Gene Name: cytidine monophosphate N-acetylneuraminic acid synthetase
  Uniprot ID: Q8NFW8
  ENSP ID: ENSP00000229329
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 21679 - protein, 88 aa, Homo sapiens
  Payload ID: 4374
  Gene Symbol: CMAS
  Gene Name: cytidine monophosphate N-acetylneuraminic acid synthetase
  ENSP ID: ENSP00000439404
MDSVEKGAATSVSNPRGRPSRGRPPKLQRNSRGGQGRGVEKPPHLAALILARGGSKGIPLKNIKHLAGVPLIGWVLRAALDSGAFQRG

SEQ ID NO: 21680 - protein, 97 aa, Homo sapiens
  Payload ID: 4374
  Gene Symbol: CMAS
  Gene Name: cytidine monophosphate N-acetylneuraminic acid synthetase
  ENSP ID: ENSP00000440605
MIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPI

SEQ ID NO: 21681 - protein, 263 aa, Homo sapiens
  Payload ID: 4374
  Gene Symbol: CMAS
  Gene Name: cytidine monophosphate N-acetylneuraminic acid synthetase
  Uniprot ID: Q8NFW8
  ENSP ID: ENSP00000446239
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLR

SEQ ID NO: 21682 - protein, 286 aa, Homo sapiens
  Payload ID: 4375
  Gene Symbol: CYBRD1
  Gene Name: cytochrome b reductase 1
  Uniprot ID: Q53TN4
  ENSP ID: ENSP00000319141
MAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 21683 - protein, 157 aa, Homo sapiens
  Payload ID: 4375
  Gene Symbol: CYBRD1
  Gene Name: cytochrome b reductase 1
  Uniprot ID: Q53TN4
  ENSP ID: ENSP00000364401
MAMEGYWRFLALLGSALLVGFLSVIFALVWVLHYREGLGWDGSALEFNWHPVLMVTGFVFIQGIASFRFFSLSASMGSAFSPSISHAHTCLFWNCHLWNSDCNSTYGIDRETDFFPERSCIQYIPARRCFRKYAWPSDPGVRGPHFLDSHQTAMETS

SEQ ID NO: 21684 - protein, 228 aa, Homo sapiens
  Payload ID: 4375
  Gene Symbol: CYBRD1
  Gene Name: cytochrome b reductase 1
  Uniprot ID: Q53TN4
  ENSP ID: ENSP00000386739
MLDEGEAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 21685 - protein, 174 aa, Homo sapiens
  Payload ID: 4375
  Gene Symbol: CYBRD1
  Gene Name: cytochrome b reductase 1
  ENSP ID: ENSP00000402242
MRRGRQRGKDCRSENLPVFVTSSALAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGA

SEQ ID NO: 21686 - protein, 195 aa, Homo sapiens
  Payload ID: 4376
  Gene Symbol: CYBA
  Gene Name: cytochrome b-245, alpha polypeptide
  Uniprot ID: P13498
  ENSP ID: ENSP00000261623
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 21687 - protein, 210 aa, Homo sapiens
  Payload ID: 4376
  Gene Symbol: CYBA
  Gene Name: cytochrome b-245, alpha polypeptide
  ENSP ID: ENSP00000454951
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLSQVPPARRGNCPPLAVRLLVCVRGKGAALSVYAFRVWKWSSVSSLTDLPPAELSFRTPSCCQVLIWAVALFSGGHPHPPRLPAATHS

SEQ ID NO: 21688 - protein, 145 aa, Homo sapiens
  Payload ID: 4376
  Gene Symbol: CYBA
  Gene Name: cytochrome b-245, alpha polypeptide
  ENSP ID: ENSP00000455506
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLACVCCLVCRICKDPLQIRGAPIRRQGLGLSVPAGFLLATILGTACLAIA

SEQ ID NO: 21689 - protein, 74 aa, Homo sapiens
  Payload ID: 4376
  Gene Symbol: CYBA
  Gene Name: cytochrome b-245, alpha polypeptide
  ENSP ID: ENSP00000455537
  MOD_RES (1)..(1): Any amino acid
XDRRGEAVRALYQELLCSGRPASPALGARRLPAGHHPWDRLPGHCERHLPTVPRRRLCVASSGRPSSPSPGSGR

SEQ ID NO: 21690 - protein, 128 aa, Homo sapiens
  Payload ID: 4376
  Gene Symbol: CYBA
  Gene Name: cytochrome b-245, alpha polypeptide
  ENSP ID: ENSP00000456079
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLVSGAL

SEQ ID NO: 21691 - protein, 130 aa, Homo sapiens
  Payload ID: 4376
  Gene Symbol: CYBA
  Gene Name: cytochrome b-245, alpha polypeptide
  ENSP ID: ENSP00000457060
MDPLGTRARECLAQHGPHHRGHRGHSWALHPVVLWCLLHCGGRVCVPAGVPPGEEEEGLHHGALGTEVHDRRGEAVRALYQELLCSGRPASPALGARRLPAGHHPWDRLPGHCERHLPTGGCAWRAVDAH

SEQ ID NO: 21692 - protein, 570 aa, Homo sapiens
  Payload ID: 4377
  Gene Symbol: CYBB
  Gene Name: cytochrome b-245, beta polypeptide
  Uniprot ID: P04839
  ENSP ID: ENSP00000367851
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 21693 - protein, 228 aa, Homo sapiens
  Payload ID: 4378
  Gene Symbol: CYB5D1
  Gene Name: cytochrome b5 domain containing 1
  Uniprot ID: Q6P9G0
  ENSP ID: ENSP00000331479
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLEVGVLESIWEILHRYLPYNSHAASYTWKYEGKNLNMDFTLEENGIRDEEEEFDYLSMDGTLHTPAILLYFNDDLTEL

SEQ ID NO: 21694 - protein, 157 aa, Homo sapiens
  Payload ID: 4378
  Gene Symbol: CYB5D1
  Gene Name: cytochrome b5 domain containing 1
  Uniprot ID: Q6P9G0
  ENSP ID: ENSP00000459369
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLELHVEI

SEQ ID NO: 21695 - protein, 30 aa, Homo sapiens
  Payload ID: 4378
  Gene Symbol: CYB5D1
  Gene Name: cytochrome b5 domain containing 1
  ENSP ID: ENSP00000460105
EYKGKGHTLGRGRSVCVCTRAFAWFSKGWH

SEQ ID NO: 21696 - protein, 100 aa, Homo sapiens
  Payload ID: 4378
  Gene Symbol: CYB5D1
  Gene Name: cytochrome b5 domain containing 1
  ENSP ID: ENSP00000461852
MPRRGLVAGPDLEYFQRRYFTPAEVGVLESIWEILHRYLPYNSHAASYTWKYEGKNLNMDFTLEENGIRDEEEEFDYLSMDGTLHTPAILLYFNDDLTEL

SEQ ID NO: 21697 - protein, 264 aa, Homo sapiens
  Payload ID: 4379
  Gene Symbol: CYB5D2
  Gene Name: cytochrome b5 domain containing 2
  Uniprot ID: Q8WUJ1
  ENSP ID: ENSP00000301391
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 21698 - protein, 152 aa, Homo sapiens
  Payload ID: 4379
  Gene Symbol: CYB5D2
  Gene Name: cytochrome b5 domain containing 2
  Uniprot ID: Q8WUJ1
  ENSP ID: ENSP00000458352
MLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 21699 - protein, 152 aa, Homo sapiens; identical to SEQ ID NO: 21698
  Payload ID: 4379
  Gene Symbol: CYB5D2
  Gene Name: cytochrome b5 domain containing 2
  Uniprot ID: Q8WUJ1
  ENSP ID: ENSP00000458903

SEQ ID NO: 21700 - protein, 106 aa, Homo sapiens
  Payload ID: 4379
  Gene Symbol: CYB5D2
  Gene Name: cytochrome b5 domain containing 2
  ENSP ID: ENSP00000461090
MLTLHNWLSFYEKNYVCVGRVTGRFYGEDGLPTPALTQVEAAITRGLEANKLQLQEKQTFPPCNAEWSSARGSRLWCSQKRGFNSSLALASGSLKHACHRLILQFL

SEQ ID NO: 21701 - protein, 305 aa, Homo sapiens
  Payload ID: 4380
  Gene Symbol: CYB5R1
  Gene Name: cytochrome b5 reductase 1
  Uniprot ID: Q9UHQ9
  ENSP ID: ENSP00000356218
MGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 21702 - protein, 226 aa, Homo sapiens
  Payload ID: 4380
  Gene Symbol: CYB5R1
  Gene Name: cytochrome b5 reductase 1
  ENSP ID: ENSP00000396382
  MOD_RES (1)..(1): Any amino acid
XTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKGILPISGHPTIPSSSKSKPCPFVNSGFIEINLASHCQLGSLSAQTQ

SEQ ID NO: 21703 - protein, 276 aa, Homo sapiens
  Payload ID: 4381
  Gene Symbol: CYB5R2
  Gene Name: cytochrome b5 reductase 2
  Uniprot ID: Q6BCY4
  ENSP ID: ENSP00000299498
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGWKYSSGFVTADMIKEHLPPPAKSTLILVCGPPPLIQTAAHPNLEKLGYTQDMIFTY

SEQ ID NO: 21704 - protein, 116 aa, Homo sapiens
  Payload ID: 4381
  Gene Symbol: CYB5R2
  Gene Name: cytochrome b5 reductase 2
  ENSP ID: ENSP00000392777
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIF

SEQ ID NO: 21705 - protein, 189 aa, Homo sapiens
  Payload ID: 4381
  Gene Symbol: CYB5R2
  Gene Name: cytochrome b5 reductase 2
  ENSP ID: ENSP00000432482
MNERRSARSTRLQLGDAPASAPPRKHPPRTRPRVGAHEDPSLLLTITVTGVTVLVLVLKSMNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGP

SEQ ID NO: 21706 - protein, 146 aa, Homo sapiens
  Payload ID: 4381
  Gene Symbol: CYB5R2
  Gene Name: cytochrome b5 reductase 2
  ENSP ID: ENSP00000433856
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTL

SEQ ID NO: 21707 - protein, 171 aa, Homo sapiens
  Payload ID: 4381
  Gene Symbol: CYB5R2
  Gene Name: cytochrome b5 reductase 2
  ENSP ID: ENSP00000434969
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITK

SEQ ID NO: 21708 - protein, 237 aa, Homo sapiens
  Payload ID: 4381
  Gene Symbol: CYB5R2
  Gene Name: cytochrome b5 reductase 2
  Uniprot ID: Q6BCY4
  ENSP ID: ENSP00000435916
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGPWSAEGATLLSNSAQFH

SEQ ID NO: 21709 - protein, 276 aa, Homo sapiens; identical to SEQ ID NO: 21703
  Payload ID: 4381
  Gene Symbol: CYB5R2
  Gene Name: cytochrome b5 reductase 2
  Uniprot ID: Q6BCY4
  ENSP ID: ENSP00000437041

SEQ ID NO: 21710 - protein, 301 aa, Homo sapiens
  Payload ID: 4382
  Gene Symbol: CYB5R3
  Gene Name: cytochrome b5 reductase 3
  Uniprot ID: P00387
  ENSP ID: ENSP00000338461
MGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 21711 - protein, 334 aa, Homo sapiens
  Payload ID: 4382
  Gene Symbol: CYB5R3
  Gene Name: cytochrome b5 reductase 3
  Uniprot ID: P00387
  ENSP ID: ENSP00000354468
MNRSLLVGCMQSKDIWGREESICERLKQDGLDVERAESWELGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 21712 - protein, 278 aa, Homo sapiens
  Payload ID: 4382
  Gene Symbol: CYB5R3
  Gene Name: cytochrome b5 reductase 3
  Uniprot ID: P00387
  ENSP ID: ENSP00000384457
MKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 21713 - protein, 278 aa, Homo sapiens; identical to SEQ ID NO: 21712
  Payload ID: 4382
  Gene Symbol: CYB5R3
  Gene Name: cytochrome b5 reductase 3
  Uniprot ID: P00387
  ENSP ID: ENSP00000384834

SEQ ID NO: 21714 - protein, 278 aa, Homo sapiens; identical to SEQ ID NO: 21712
  Payload ID: 4382
  Gene Symbol: CYB5R3
  Gene Name: cytochrome b5 reductase 3
  Uniprot ID: P00387
  ENSP ID: ENSP00000385679

SEQ ID NO: 21715 - protein, 147 aa, Homo sapiens
  Payload ID: 4382
  Gene Symbol: CYB5R3
  Gene Name: cytochrome b5 reductase 3
  ENSP ID: ENSP00000403439
MKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIR

SEQ ID NO: 21716 - protein, 109 aa, Homo sapiens
  Payload ID: 4383
  Gene Symbol: CYB5R4
  Gene Name: cytochrome b5 reductase 4
  ENSP ID: ENSP00000358693
MDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKGKLWHL

SEQ ID NO: 21717 - protein, 521 aa, Homo sapiens
  Payload ID: 4383
  Gene Symbol: CYB5R4
  Gene Name: cytochrome b5 reductase 4
  Uniprot ID: Q7L1T6
  ENSP ID: ENSP00000358695
MLNVPSQSFPAPRSQQRVASGGRSKVPLKQGRSLMDWIRLTKSGKDLTGLKGRLIEVTEEELKKHNKKDDCWICIRGFVYNVSPYMEYHPGGEDELMRAAGSDGTELFDQVHRWVNYESMLKECLVGRMAIKPAVLKDYREEEKKVLNGMLPKSQVTDTLAKEGPSYPSYDWFQTDSLVTIAIYTKQKDINLDSIIVDHQNDSFRAETIIKDCLYLIHIGLSHEVQEDFSVRVVESVGKIEIVLQKKENTSWDFLGHPLKNHNSLIPRKDTGLYYRKCQLISKEDVTHDTRLFCLMLPPSTHLQVPIGQHVYLKLPITGTEIVKPYTPVSGSLLSEFKEPVLPNNKYIYFLIKIYPTGLFTPELDRLQIGDFVSVSSPEGNFKISKFQELEDLFLLAAGTGFTPMVKILNYALTDIPSLRKVKLMFFNKTEDDIIWRSQLEKLAFKDKRLDVEFVLSAPISEWNGKQGHISPALLSEFLKRNLDKSKVLVCICGPVPFTEQGVRLLHDLNFSKNEIHSFTA

SEQ ID NO: 21718 - protein, 247 aa, Homo sapiens
  Payload ID: 4384
  Gene Symbol: CYB5RL
  Gene Name: cytochrome b5 reductase-like
  Uniprot ID: Q6IPT4
  ENSP ID: ENSP00000287899
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRGIVDDLEIQRAYTPISPANAEGYFEVLIKCYQMGLMSRYVESWRVGDTAFWRGPFGDFFYKPNQESSSEQLPWSYQEKTHFGHLGQDLIKELVSCCRRKPFALVCGSAEFTKDIARCLLCAGLTEDSYFLF

SEQ ID NO: 21719 - protein, 70 aa, Homo sapiens
  Payload ID: 4384
  Gene Symbol: CYB5RL
  Gene Name: cytochrome b5 reductase-like
  ENSP ID: ENSP00000394709
MMAEREEDDDTEEAWMQLRPTEPLPSQCCGSGCSPCVFDLYHRDLARWEAAQASKDRSLLRGPESQRDSR

SEQ ID NO: 21720 - protein, 55 aa, Homo sapiens
  Payload ID: 4384
  Gene Symbol: CYB5RL
  Gene Name: cytochrome b5 reductase-like
  ENSP ID: ENSP00000403021
MQLRPTEPLPSQCCGSGCSPCVFDLYHRDLARWEAAQASKDRSLLRGPESQRDSR

SEQ ID NO: 21721 - protein, 138 aa, Homo sapiens
  Payload ID: 4384
  Gene Symbol: CYB5RL
  Gene Name: cytochrome b5 reductase-like
  ENSP ID: ENSP00000431157
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRYTQVAGGPKLHSPALLFASCWP

SEQ ID NO: 21722 - protein, 123 aa, Homo sapiens
  Payload ID: 4384
  Gene Symbol: CYB5RL
  Gene Name: cytochrome b5 reductase-like
  ENSP ID: ENSP00000431428
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRYTQRDSR

SEQ ID NO: 21723 - protein, 315 aa, Homo sapiens
  Payload ID: 4384
  Gene Symbol: CYB5RL
  Gene Name: cytochrome b5 reductase-like
  Uniprot ID: Q6IPT4
  ENSP ID: ENSP00000434343
MMAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRGIVDDLEIQRAYTPISPANAEGYFEVLIKCYQMGLMSRYVESWRVGDTAFWRGPFGDFFYKPNQYGELLLLAAGTGLAPMVPILQSITDNENDETFVTLVGCFKTFESIYLKTFLQEQARFWNVRTFFVLSQESSSEQLPWSYQEKTHFGHLGQDLIKELVSCCRRKPFALVCGSAEFTKDIARCLLCAGLTEDSYFLF

SEQ ID NO: 21724 - protein, 176 aa, Homo sapiens
  Payload ID: 4384
  Gene Symbol: CYB5RL
  Gene Name: cytochrome b5 reductase-like
  ENSP ID: ENSP00000434606
RGPESQSCPSKLNPETFVAFCIIAMDRLTKDTYRVRFALPGNSQLGLRPGQHLILRYTQCYQMGLMSRYVESWRVGDTAFWRGPFGDFFYKPNQYGELLLLAAGTGLAPMVPILQSITDNENDETFVTLVGCFKTFESIYLKTFLQEQARFWNVRTFFVLSQLVESTNVEPMDTEG

SEQ ID NO: 21725 - protein, 60 aa, Homo sapiens
  Payload ID: 4385
  Gene Symbol: CYB5A
  Gene Name: cytochrome b5 type A (microsomal)
  ENSP ID: ENSP00000299438
MSKTFIIGELHPDDRPKLNKPPETLITTIDSSSSWWTNWVIPAISAVAVALMYRLYMAED

SEQ ID NO: 21726 - protein, 134 aa, Homo sapiens
  Payload ID: 4385
  Gene Symbol: CYB5A
  Gene Name: cytochrome b5 type A (microsomal)
  Uniprot ID: P00167
  ENSP ID: ENSP00000341625
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 21727 - protein, 124 aa, Homo sapiens
  Payload ID: 4385
  Gene Symbol: CYB5A
  Gene Name: cytochrome b5 type A (microsomal)
  Uniprot ID: P00167
  ENSP ID: ENSP00000381011
MAEQSDEAVKYYTLEEIQKHNHSKSTWLILHHKVYDLTKFLEEHPGGEEVLREQAGGDATENFEDVGHSTDAREMSKTFIIGELHPETLITTIDSSSSWWTNWVIPAISAVAVALMYRLYMAED

SEQ ID NO: 21728 - protein, 98 aa, Homo sapiens
  Payload ID: 4385
  Gene Symbol: CYB5A
  Gene Name: cytochrome b5 type A (microsomal)
  Uniprot ID: P00167
  ENSP ID: ENSP00000436461
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 21729 - protein, 150 aa, Homo sapiens
  Payload ID: 4386
  Gene Symbol: CYB5B
  Gene Name: cytochrome b5 type B (outer mitochondrial membrane)
  ENSP ID: ENSP00000308430
MSGSMATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 21730 - protein, 131 aa, Homo sapiens
  Payload ID: 4386
  Gene Symbol: CYB5B
  Gene Name: cytochrome b5 type B (outer mitochondrial membrane)
  ENSP ID: ENSP00000421492
MATAEASGSDGKGQEVETSVTYYRLEEVAKRNSLKELWLVIHGRVYDVTRFLNEHPGGEEVLLEQAGVDASESFEDVGHSSDAREMLKQYYIGDIHPLLGILDFTHHRRCSLRFPVPLLHIGKQILLRRPC

SEQ ID NO: 21731 - protein, 146 aa, Homo sapiens
  Payload ID: 4386
  Gene Symbol: CYB5B
  Gene Name: cytochrome b5 type B (outer mitochondrial membrane)
  Uniprot ID: O43169
  ENSP ID: ENSP00000423679
MATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 21732 - protein, 140 aa, Homo sapiens
  Payload ID: 4386
  Gene Symbol: CYB5B
  Gene Name: cytochrome b5 type B (outer mitochondrial membrane)
  ENSP ID: ENSP00000457848
MATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKRRCSLRFPVPLLHIGKQILLRRPC

SEQ ID NO: 21733 - protein, 64 aa, Homo sapiens
  Payload ID: 4386
  Gene Symbol: CYB5B
  Gene Name: cytochrome b5 type B (outer mitochondrial membrane)
  ENSP ID: ENSP00000464102
KRNSLKELWLVIHGRVYDVTRFLNEDPSKNDTCKSCWAYWILPIIGAVLLGFLYRYYTSESKSS

SEQ ID NO: 21734 - protein, 251 aa, Homo sapiens
  Payload ID: 4387
  Gene Symbol: CYB561
  Gene Name: cytochrome b561
  Uniprot ID: P49447
  ENSP ID: ENSP00000354028
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 21735 - protein, 251 aa, Homo sapiens; identical to SEQ ID NO: 21734
  Payload ID: 4387
  Gene Symbol: CYB561
  Gene Name: cytochrome b561
  Uniprot ID: P49447
  ENSP ID: ENSP00000376701

SEQ ID NO: 21736 - protein, 251 aa, Homo sapiens; identical to SEQ ID NO: 21734
  Payload ID: 4387
  Gene Symbol: CYB561
  Gene Name: cytochrome b561
  Uniprot ID: P49447
  ENSP ID: ENSP00000376702

SEQ ID NO: 21737 - protein, 138 aa, Homo sapiens
  Payload ID: 4387
  Gene Symbol: CYB561
  Gene Name: cytochrome b561
  Uniprot ID: P49447
  ENSP ID: ENSP00000400350
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQGQV

SEQ ID NO: 21738 - protein, 318 aa, Homo sapiens
  Payload ID: 4387
  Gene Symbol: CYB561
  Gene Name: cytochrome b561
  ENSP ID: ENSP00000442773
MKQKTKPGTGPLSSLEFGVSFLAPSPHMELLASCPRSRLSPWGGWAPPPSHSRDLRPLPQDDGVCLSMEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 21739 - protein, 251 aa, Homo sapiens; identical to SEQ ID NO: 21734
  Payload ID: 4387
  Gene Symbol: CYB561
  Gene Name: cytochrome b561
  Uniprot ID: P49447
  ENSP ID: ENSP00000462325

SEQ ID NO: 21740 - protein, 251 aa, Homo sapiens; identical to SEQ ID NO: 21734
  Payload ID: 4387
  Gene Symbol: CYB561
  Gene Name: cytochrome b561
  Uniprot ID: P49447
  ENSP ID: ENSP00000462543

SEQ ID NO: 21741 - protein, 305 aa, Homo sapiens
  Payload ID: 4387
  Gene Symbol: CYB561
  Gene Name: cytochrome b561
  ENSP ID: ENSP00000462545
  MOD_RES (1)..(1): Any amino acid
XFLAPSPHMELLASCPRSRLSPWGGWAPPPSHSRDLRPLPQDDGWEGACGVCLSMEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 21742 - protein, 194 aa, Homo sapiens
  Payload ID: 4387
  Gene Symbol: CYB561
  Gene Name: cytochrome b561
  ENSP ID: ENSP00000463162
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGEFPGAAFPATCLPLQAWWRCSTTTGRRATLTCTAYTAGAGSLSLSCTLCSGWWASASSCSPELHSPCGAATAHSTSSLVLPSSSFPWAPPCWA

SEQ ID NO: 21743 - protein, 94 aa, Homo sapiens
  Payload ID: 4387
  Gene Symbol: CYB561
  Gene Name: cytochrome b561
  ENSP ID: ENSP00000463680
MWQRELGSREGAHHWEGLKTSSWALQGRACAGVCLSMEGGAAAATPTALPYYVAFSQLLGLTLVAMTGAWLGLYRGGIAWESDLQFNAHPLCMV

SEQ ID NO: 21744 - protein, 73 aa, Homo sapiens
  Payload ID: 4387
  Gene Symbol: CYB561
  Gene Name: cytochrome b561
  ENSP ID: ENSP00000464012
  MOD_RES (1)..(1): Any amino acid
XYRPQHIFFGATIFLLSVGTALLGLKEALLFNLGFSLPLTPAGASIAHLSPRVSWPTCWACCWPASVGRCSTS

SEQ ID NO: 21745 - protein, 142 aa, Homo sapiens
  Payload ID: 4387
  Gene Symbol: CYB561
  Gene Name: cytochrome b561
  ENSP ID: ENSP00000464193
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGEFPGAAFPATCLPLQAWWRCSTTTGRRATLTCTAYTAGAGS

SEQ ID NO: 21746 - protein, 258 aa, Homo sapiens
  Payload ID: 4387
  Gene Symbol: CYB561
  Gene Name: cytochrome b561
  ENSP ID: ENSP00000464215
MSSVCLSMEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 21747 - protein, 210 aa, Homo sapiens
  Payload ID: 4387
  Gene Symbol: CYB561
  Gene Name: cytochrome b561
  ENSP ID: ENSP00000464470
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGKSGWSQNNYSHPPWCLHITPAP

SEQ ID NO: 21748 - protein, 222 aa, Homo sapiens
  Payload ID: 4387
  Gene Symbol: CYB561
  Gene Name: cytochrome b561
  ENSP ID: ENSP00000464520
MTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 21749 - protein, 242 aa, Homo sapiens
  Payload ID: 4388
  Gene Symbol: CYB561A3
  Gene Name: cytochrome b561 family, member A3
  Uniprot ID: Q8NBI2
  ENSP ID: ENSP00000294072
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 21750 - protein, 263 aa, Homo sapiens
  Payload ID: 4388
  Gene Symbol: CYB561A3
  Gene Name: cytochrome b561 family, member A3
  ENSP ID: ENSP00000389745
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQLLLQLRPGSRPFPVTYVSVTGRQPYKSW

SEQ ID NO: 21751 - protein, 259 aa, Homo sapiens
  Payload ID: 4388
  Gene Symbol: CYB561A3
  Gene Name: cytochrome b561 family, member A3
  Uniprot ID: Q8NBI2
  ENSP ID: ENSP00000398979
MGKNFSDSFLSRECVIRMVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 21752 - protein, 242 aa, Homo sapiens; identical to SEQ ID NO: 21749
  Payload ID: 4388
  Gene Symbol: CYB561A3
  Gene Name: cytochrome b561 family, member A3
  Uniprot ID: Q8NBI2
  ENSP ID: ENSP00000437390

SEQ ID NO: 21753 - protein, 55 aa, Homo sapiens
  Payload ID: 4388
  Gene Symbol: CYB561A3
  Gene Name: cytochrome b561 family, member A3
  ENSP ID: ENSP00000437819
MVSGRFYLSCLLLGSLGSMCILFTIYWMQYWRGGFAWNGSIYMFNWHPVLMVAGM

SEQ ID NO: 21754 - protein, 182 aa, Homo sapiens
  Payload ID: 4388
  Gene Symbol: CYB561A3
  Gene Name: cytochrome b561 family, member A3
  ENSP ID: ENSP00000438725
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFS

SEQ ID NO: 21755 - protein, 28 aa, Homo sapiens
  Payload ID: 4388
  Gene Symbol: CYB561A3
  Gene Name: cytochrome b561 family, member A3
  ENSP ID: ENSP00000439702
MVSGRFYLSCLLLGSLGSMCILFTIYWM

SEQ ID NO: 21756 - protein, 124 aa, Homo sapiens
  Payload ID: 4388
  Gene Symbol: CYB561A3
  Gene Name: cytochrome b561 family, member A3
  ENSP ID: ENSP00000441085
MAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGL

SEQ ID NO: 21757 - protein, 95 aa, Homo sapiens
  Payload ID: 4388
  Gene Symbol: CYB561A3
  Gene Name: cytochrome b561 family, member A3
  ENSP ID: ENSP00000441834
MVSGRFYLSCLLLGSLGSMCILFTIYWMQYWRGGFAWNGSIYMFNWHPVLMVAGMVVFYGGAGWASPLSSSSPASGSWALLSSSCPGRPCGCAAS

SEQ ID NO: 21758 - protein, 115 aa, Homo sapiens
  Payload ID: 4388
  Gene Symbol: CYB561A3
  Gene Name: cytochrome b561 family, member A3
  ENSP ID: ENSP00000443005
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYS

SEQ ID NO: 21759 - protein, 199 aa, Homo sapiens
  Payload ID: 4388
  Gene Symbol: CYB561A3
  Gene Name: cytochrome b561 family, member A3
  ENSP ID: ENSP00000443321
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVF

SEQ ID NO: 21760 - protein, 109 aa, Homo sapiens
  Payload ID: 4388
  Gene Symbol: CYB561A3
  Gene Name: cytochrome b561 family, member A3
  ENSP ID: ENSP00000443756
MVSGRFYLSCLLLGSLGSMCILFTIYWMQYWRGGFAWNGSIYMFNWHPVLMVAGMVVFYGGGKTPPGHTTACPVRRSLPTAPGCWWWPLGCWCSTSFWLHLGSAQSRGS

SEQ ID NO: 21761 - protein, 105 aa, Homo sapiens
  Payload ID: 4388
  Gene Symbol: CYB561A3
  Gene Name: cytochrome b561 family, member A3
  ENSP ID: ENSP00000445561
MVSGRFYLSCLLLGSLGSMCILFTIYWMQYWRGGFAWNGSIYMFNWHPVLMVAGMVVFYGGVVPGLCCLPPALGVHVAAQPPKTYPRLFWSRHPLSVHRIRHFGH

SEQ ID NO: 21762 - protein, 104 aa, Homo sapiens
  Payload ID: 4388
  Gene Symbol: CYB561A3
  Gene Name: cytochrome b561 family, member A3
  ENSP ID: ENSP00000446158
MVSGRFYLSCLLLGSLGSMCILFTIYWMQYWRGGFAWNGSIYMFNWHPVLMVAGMVVFYGGGHTTACPVRRSLPTAPGCWWWPLGCWCSTSFWLHLGSAQSRGS

SEQ ID NO: 21763 - protein, 133 aa, Homo sapiens
  Payload ID: 4389
  Gene Symbol: CYB561D1
  Gene Name: cytochrome b561 family, member D1
  Uniprot ID: Q8N8Q1
  ENSP ID: ENSP00000309324
MQPLEVGLVPAPAGEPRLTRWLRRGSGILAHLVALGFTIFLTALSRPGTKTGPLMEDRSEGGRARWVMPEIPALWEADAGGSLEVFSPGTLYSWPWRSASAWLKPSYSSHLNTPCSSSAPEKHGSGSTGQGRP

SEQ ID NO: 21764 - protein, 251 aa, Homo sapiens
  Payload ID: 4389
  Gene Symbol: CYB561D1
  Gene Name: cytochrome b561 family, member D1
  Uniprot ID: Q8N8Q1
  ENSP ID: ENSP00000358884
MQPLEVGLVPAPAGEPRLTRWLRRGSGILAHLVALGFTIFLTALSRPGTKTGPLMEDRSEGGRARWVMPEIPALWEADAGGSLEFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 21765 - protein, 172 aa, Homo sapiens
  Payload ID: 4389
  Gene Symbol: CYB561D1
  Gene Name: cytochrome b561 family, member D1
  Uniprot ID: Q8N8Q1
  ENSP ID: ENSP00000377312
MQPLEFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 21766 - protein, 229 aa, Homo sapiens
  Payload ID: 4389
  Gene Symbol: CYB561D1
  Gene Name: cytochrome b561 family, member D1
  Uniprot ID: Q8N8Q1
  ENSP ID: ENSP00000413530
MQPLEVGLVPAPAGEPRLTRWLRRGSGILAHLVALGFTIFLTALSRPGTSLFSWHPVFMALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 21767 - protein, 128 aa, Homo sapiens
  Payload ID: 4389
  Gene Symbol: CYB561D1
  Gene Name: cytochrome b561 family, member D1
  Uniprot ID: Q8N8Q1
  ENSP ID: ENSP00000416898
MQPLEVGLVPAPAGEPRLTRWLRRGSGILAHLVALGFTIFLTALSRPGTKTGPLMEDRSEGGRARWVMPEIPALWEADAGGSLEVFSPGTLYSWPWRMYESTSFFSGLQARHEAYWLSPMFTVLPLHG

SEQ ID NO: 21768 - protein, 55 aa, Homo sapiens
  Payload ID: 4389
  Gene Symbol: CYB561D1
  Gene Name: cytochrome b561 family, member D1
  ENSP ID: ENSP00000433095
MQPLEVGLVPAPAGEPRLTRWLRRGSGILAHLVALGFTIFLTALSRPGTILPLHG

SEQ ID NO: 21769 - protein, 231 aa, Homo sapiens
  Payload ID: 4389
  Gene Symbol: CYB561D1
  Gene Name: cytochrome b561 family, member D1
  ENSP ID: ENSP00000434344
MQPLEVGLVPAPAGEPRLTRWLRRGSGILAHLVALGFTIFLTALSRPGTSLFSWHPVFMALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEIAT

SEQ ID NO: 21770 - protein, 54 aa, Homo sapiens
  Payload ID: 4389
  Gene Symbol: CYB561D1
  Gene Name: cytochrome b561 family, member D1
  ENSP ID: ENSP00000435802
MQPLEVFSPGTLYSWPWRSASAWLKPSYSSHLNTPCSSSAPEKHGSGSTGQGRP

SEQ ID NO: 21771 - protein, 64 aa, Homo sapiens
  Payload ID: 4389
  Gene Symbol: CYB561D1
  Gene Name: cytochrome b561 family, member D1
  ENSP ID: ENSP00000435819
MQPLEVGLVPAPAGEPRLTRWLRRGSGILAHLVALGFTIFLTALSRPGTSLFSWHPVFMALADV

SEQ ID NO: 21772 - protein, 222 aa, Homo sapiens
  Payload ID: 4390
  Gene Symbol: CYB561D2
  Gene Name: cytochrome b561 family, member D2
  Uniprot ID: O14569
  ENSP ID: ENSP00000232508
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 21773 - protein, 222 aa, Homo sapiens; identical to SEQ ID NO: 21772
  Payload ID: 4390
  Gene Symbol: CYB561D2
  Gene Name: cytochrome b561 family, member D2
  Uniprot ID: O14569
  ENSP ID: ENSP00000391209

SEQ ID NO: 21774 - protein, 222 aa, Homo sapiens; identical to SEQ ID NO: 21772
  Payload ID: 4390
  Gene Symbol: CYB561D2
  Gene Name: cytochrome b561 family, member D2
  Uniprot ID: O14569
  ENSP ID: ENSP00000400454

SEQ ID NO: 21775 - protein, 222 aa, Homo sapiens; identical to SEQ ID NO: 21772
  Payload ID: 4390
  Gene Symbol: CYB561D2
  Gene Name: cytochrome b561 family, member D2
  Uniprot ID: O14569
  ENSP ID: ENSP00000410663

SEQ ID NO: 21776 - protein, 146 aa, Homo sapiens
  Payload ID: 4391
  Gene Symbol: COA1
  Gene Name: cytochrome c oxidase assembly factor 1 homolog
  Uniprot ID: Q9GZY4
  ENSP ID: ENSP00000223336
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 21777 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000312100

SEQ ID NO: 21778 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000379218

SEQ ID NO: 21779 - protein, 63 aa, Homo sapiens
  Payload ID: 4391
  Gene Symbol: COA1
  Gene Name: cytochrome c oxidase assembly factor 1 homolog
  ENSP ID: ENSP00000387433
MMWQKYAGSRRSMPLGARILFHGVFYAGGFAIVYYLIQSKYPASRLRPDLLLACSCSSIRGNT

SEQ ID NO: 21780 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000395586

SEQ ID NO: 21781 - protein, 34 aa, Homo sapiens
  Payload ID: 4391
  Gene Symbol: COA1
  Gene Name: cytochrome c oxidase assembly factor 1 homolog
  ENSP ID: ENSP00000398886
MMWQKVMECSRAKFPTRTCQGILELDNRRKSLPE

SEQ ID NO: 21782 - protein, 34 aa, Homo sapiens; identical to SEQ ID NO: 21781
  Payload ID: 4391
  Gene Symbol: COA1
  Gene Name: cytochrome c oxidase assembly factor 1 homolog
  ENSP ID: ENSP00000400271

SEQ ID NO: 21783 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000400759

SEQ ID NO: 21784 - protein, 113 aa, Homo sapiens
  Payload ID: 4391
  Gene Symbol: COA1
  Gene Name: cytochrome c oxidase assembly factor 1 homolog
  ENSP ID: ENSP00000405582
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQ

SEQ ID NO: 21785 - protein, 63 aa, Homo sapiens; identical to SEQ ID NO: 21779
  Payload ID: 4391
  Gene Symbol: COA1
  Gene Name: cytochrome c oxidase assembly factor 1 homolog
  ENSP ID: ENSP00000410365

SEQ ID NO: 21786 - protein, 41 aa, Homo sapiens
  Payload ID: 4391
  Gene Symbol: COA1
  Gene Name: cytochrome c oxidase assembly factor 1 homolog
  ENSP ID: ENSP00000411540
MMWQKYAGSRRSMPLGARILFHGVFYAGGFAIVYYLIQRGC

SEQ ID NO: 21787 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000413777

SEQ ID NO: 21788 - protein, 146 aa, Homo sapiens; identical to SEQ ID NO: 21776
  Payload ID: 4391
  Gene Symbol: COA1
  Gene Name: cytochrome c oxidase assembly factor 1 homolog
  Uniprot ID: Q9GZY4
  ENSP ID: ENSP00000416406

SEQ ID NO: 21789 - protein, 88 aa, Homo sapiens
  Payload ID: 4391
  Gene Symbol: COA1
  Gene Name: cytochrome c oxidase assembly factor 1 homolog
  ENSP ID: ENSP00000417046
MMWQKYAGSRRSMPLGARILFHGVFYAGGFAIVYYLIQKFHSRALYYKLAVEQLQSHPEAQEALGPPLNIHYLKLIDRENFVDIVDAK

SEQ ID NO: 21790 - protein, 106 aa, Homo sapiens
  Payload ID: 4392
  Gene Symbol: COA3
  Gene Name: cytochrome c oxidase assembly factor 3
  Uniprot ID: Q9Y2R0
  ENSP ID: ENSP00000354762
MASSGAGDPLDSKRGEAPFAQRIDPTREKLTPEQLHSMRQAELAQWQKVLPRRRTRNIVTGLGIGALVLAIYGYTFYSISQERFLDELEDEAKAARARALARASGS

SEQ ID NO: 21791 - protein, 71 aa, Homo sapiens
  Payload ID: 4392
  Gene Symbol: COA3
  Gene Name: cytochrome c oxidase assembly factor 3
  ENSP ID: ENSP00000467546
MASSGAGDPLDSKRGEAPFAQRIDPTREKLTPEQLHSMRQAELAQWQKVLPRRRTRNIVTGLGIGALVLAI

SEQ ID NO: 21792 - protein, 87 aa, Homo sapiens [sequence omitted]

SEQ ID NO: 21793 - protein, 87 aa, Homo sapiens [sequence omitted]

SEQ ID NO: 21794 - protein, 96 aa, Homo sapiens
  Payload ID: 4393
  Gene Symbol: COA4
  Gene Name: cytochrome c oxidase assembly factor 4 homolog
  Uniprot ID: Q9NYJ1
  ENSP ID: ENSP00000440756
MFYRLPIPRMSTSVPQGHTWTQRVKKDDEEEDPLDQLISRSGCAASHFAVQECMAQHQDWRQCQPQVQAFKDCMSEQQARRQEELQRRQEQAGAHH

SEQ ID NO: 21795 - protein, 87 aa, Homo sapiens [sequence omitted]

SEQ ID NO: 21796 - protein, 74 aa, Homo sapiens
  Payload ID: 4394
  Gene Symbol: COA5
  Gene Name: cytochrome c oxidase assembly factor 5
  Uniprot ID: Q86WW8
  ENSP ID: ENSP00000330730
MPKYYEDKPQGGACAGLKEDLGACLLQSDCVVQEGKSPRQCLKEGYCNSLKYAFFECKRSVLDNRARFRGRKGY

SEQ ID NO: 21797 - protein, 73 aa, Homo sapiens
  Payload ID: 4394
  Gene Symbol: COA5
  Gene Name: cytochrome c oxidase assembly factor 5
  ENSP ID: ENSP00000386934
MPKYYEDKPQGGACAGLKEDLGACLLQSDCVVQEGKSPRQCLKEGYCNSLKYAFFECKRSVMESRSVARAGVQ

SEQ ID NO: 21798 - protein, 79 aa, Homo sapiens
  Payload ID: 4395
  Gene Symbol: COA6
  Gene Name: cytochrome c oxidase assembly factor 6
  Uniprot ID: Q5JTJ3
  ENSP ID: ENSP00000355571
MAAPSMKERQVCWGARDEYWKCLDENLEDASQCKKLRSSFESSCPQQWIKYFDKRRDYLKFKEKFEAGQFEPSETTAKS

SEQ ID NO: 21799 - protein, 125 aa, Homo sapiens
  Payload ID: 4395
  Gene Symbol: COA6
  Gene Name: cytochrome c oxidase assembly factor 6
  Uniprot ID: Q5JTJ3
  ENSP ID: ENSP00000355572
MGPGGPLLSPSRGFLLCKTGWHSNRLLGDCGPHTPVSTALSFIAVGMAAPSMKERQVCWGARDEYWKCLDENLEDASQCKKLRSSFESSCPQQWIKYFDKRRDYLKFKEKFEAGQFEPSETTAKS

SEQ ID NO: 21800 - protein, 155 aa, Homo sapiens
  Payload ID: 4395
  Gene Symbol: COA6
  Gene Name: cytochrome c oxidase assembly factor 6
  ENSP ID: ENSP00000355574
MVARKGQKSPRFRRVSCFLRLGRSTLLELEPAGRPCSGRTRHRALHRRLVACVTVSSRRHRKEAGRGRAESFIAVGMAAPSMKERQVCWGARDEYWKCLDENLEDASQCKKLRSSFESSCPQQWIKYFDKRRDYLKFKEKFEAGQFEPSETTAKS

SEQ ID NO: 21801 - protein, 79 aa, Homo sapiens; identical to SEQ ID NO: 21798
  Payload ID: 4395
  Gene Symbol: COA6
  Gene Name: cytochrome c oxidase assembly factor 6
  Uniprot ID: Q5JTJ3
  ENSP ID: ENSP00000479686

SEQ ID NO: 21802 - protein, 231 aa, Homo sapiens
  Payload ID: 4396
  Gene Symbol: COA7
  Gene Name: cytochrome c oxidase assembly factor 7 (putative)
  Uniprot ID: Q96BR5
  ENSP ID: ENSP00000360593
MAGMVDFQDEEQVKSFLENMEVECNYHCYHEKDPDGCYRLVDYLEGIRKNFDEAAKVLKFNCEENQHSDSCYKLGAYYVTGKGGLTQDLKAAARCFLMACEKPGKKSIAACHNVGLLAHDGQVNEDGQPDLGKARDYYTRACDGGYTSSCFNLSAMFLQGAPGFPKDMDLACKYSMKACDLGHIWACANASRMYKLGDGVDKDEAKAEVLKNRAQQLHKEQQKGVQPLTFG

SEQ ID NO: 21803 - protein, 410 aa, Homo sapiens
  Payload ID: 4397
  Gene Symbol: COX15
  Gene Name: cytochrome c oxidase assembly homolog 15 (yeast)
  Uniprot ID: Q7KZN9
  ENSP ID: ENSP00000016171
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 21804 - protein, 388 aa, Homo sapiens
  Payload ID: 4397
  Gene Symbol: COX15
  Gene Name: cytochrome c oxidase assembly homolog 15 (yeast)
  Uniprot ID: Q7KZN9
  ENSP ID: ENSP00000359514
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQGPVLFNFTFKISDLDEGIRNI

SEQ ID NO: 21805 - protein, 169 aa, Homo sapiens
  Payload ID: 4398
  Gene Symbol: COX4I1
  Gene Name: cytochrome c oxidase subunit IV isoform 1
  Uniprot ID: P13073
  ENSP ID: ENSP00000253452
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 21806 - protein, 126 aa, Homo sapiens
  Payload ID: 4398
  Gene Symbol: COX4I1
  Gene Name: cytochrome c oxidase subunit IV isoform 1
  ENSP ID: ENSP00000454714
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYGE

SEQ ID NO: 21807 - protein, 43 aa, Homo sapiens
  Payload ID: 4398
  Gene Symbol: COX4I1
  Gene Name: cytochrome c oxidase subunit IV isoform 1
  ENSP ID: ENSP00000454869
MLATRVFSLVGKRAISTSVCVRAHESVVKSEDFSLPAYMDRRD

SEQ ID NO: 21808 - protein, 139 aa, Homo sapiens
  Payload ID: 4398
  Gene Symbol: COX4I1
  Gene Name: cytochrome c oxidase subunit IV isoform 1
  ENSP ID: ENSP00000455030
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYGHLGLCLSDPVIHSL

SEQ ID NO: 21809 - protein, 108 aa, Homo sapiens
  Payload ID: 4398
  Gene Symbol: COX4I1
  Gene Name: cytochrome c oxidase subunit IV isoform 1
  ENSP ID: ENSP00000455301
MDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRML

SEQ ID NO: 21810 - protein, 42 aa, Homo sapiens
  Payload ID: 4398
  Gene Symbol: COX4I1
  Gene Name: cytochrome c oxidase subunit IV isoform 1
  ENSP ID: ENSP00000455437
MLATRVFSLVGKRAISTSVCVRAHVETGFHHVSQDGLDLLTS

SEQ ID NO: 21811 - protein, 83 aa, Homo sapiens
  Payload ID: 4398
  Gene Symbol: COX4I1
  Gene Name: cytochrome c oxidase subunit IV isoform 1
  ENSP ID: ENSP00000456452
MLATRVFSLVGKRAISTSVCVRAHESVVKSEDFSLPAYMDRRDHPLPEVAHVKHLSASQKALKEKEKASWSSLSMDEKVECGY

SEQ ID NO: 21812 - protein, 169 aa, Homo sapiens; identical to SEQ ID NO: 21805
  Payload ID: 4398
  Gene Symbol: COX4I1
  Gene Name: cytochrome c oxidase subunit IV isoform 1
  Uniprot ID: P13073
  ENSP ID: ENSP00000457015

SEQ ID NO: 21813 - protein, 169 aa, Homo sapiens; identical to SEQ ID NO: 21805
  Payload ID: 4398
  Gene Symbol: COX4I1
  Gene Name: cytochrome c oxidase subunit IV isoform 1
  Uniprot ID: P13073
  ENSP ID: ENSP00000457513

SEQ ID NO: 21814 - protein, 171 aa, Homo sapiens
  Payload ID: 4399
  Gene Symbol: COX4I2
  Gene Name: cytochrome c oxidase subunit IV isoform 2 (lung)
  Uniprot ID: Q96KJ9
  ENSP ID: ENSP00000365243
MLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 21815 - protein, 150 aa, Homo sapiens
  Payload ID: 4400
  Gene Symbol: COX5A
  Gene Name: cytochrome c oxidase subunit Va
  Uniprot ID: P20674
  ENSP ID: ENSP00000317780
MLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 21816 - protein, 153 aa, Homo sapiens
  Payload ID: 4400
  Gene Symbol: COX5A
  Gene Name: cytochrome c oxidase subunit Va
  ENSP ID: ENSP00000455053
MLGAALRRCAVAATTRADPRGLLHSARTPGPAVAIQSVRCYSHGSQETDEEFDARWVTYFNKPDIDAWELRKGINTLVTYDMVPEPKIIDAALRACRRLNDFASTVRILEVVKMGFPKDLLTLLLECEQLPGNTDDNILPYLNKFSFIEYQAM

SEQ ID NO: 21817 - protein, 84 aa, Homo sapiens
  Payload ID: 4400
  Gene Symbol: COX5A
  Gene Name: cytochrome c oxidase subunit Va
  ENSP ID: ENSP00000456253
MLGAALRRCAVAATTRADPRGLLHSARTPGPAVAIQSVRCYSHGSQETDEEFDARWVTYFNKPDIDAWELRKDGLPQGFIDIAT

SEQ ID NO: 21818 - protein, 69 aa, Homo sapiens
  Payload ID: 4400
  Gene Symbol: COX5A
  Gene Name: cytochrome c oxidase subunit Va
  ENSP ID: ENSP00000456314
MVPEPKIIDAALRACRRLNDFASTVRILEVVKDKAGPHKEIYPYVIQELRPTLNELGISTPEELGLDKV

SEQ ID NO: 21819 - protein, 150 aa, Homo sapiens; identical to SEQ ID NO: 21815
  Payload ID: 4400
  Gene Symbol: COX5A
  Gene Name: cytochrome c oxidase subunit Va
  Uniprot ID: P20674
  ENSP ID: ENSP00000456386

SEQ ID NO: 21820 - protein, 111 aa, Homo sapiens
  Payload ID: 4400
  Gene Symbol: COX5A
  Gene Name: cytochrome c oxidase subunit Va
  ENSP ID: ENSP00000457974
MLGAALRRCAVAATTRADPRGLLHSARTPGPAVGINTLVTYDMVPEPKIIDAALRACRRLNDFASTVRILEVVKDKAGPHKEIYPYVIQELRPTLNELGISTPEELGLDKV

SEQ ID NO: 21821 - protein, 129 aa, Homo sapiens
  Payload ID: 4401
  Gene Symbol: COX5B
  Gene Name: cytochrome c oxidase subunit Vb
  Uniprot ID: P10606
  ENSP ID: ENSP00000258424
MASRLLRGAGTLAAQALRARGPSGAAAMRSMASGGGVPTDEEQATGLEREIMLAAKKGLDPYNVLAPKGASGTREDPNLVPSISNKRIVGCICEEDNTSVVWFWLHKGEAQRCPRCGAHYKLVPQQLAH

SEQ ID NO: 21822 - protein, 109 aa, Homo sapiens
  Payload ID: 4402
  Gene Symbol: COX6A1
  Gene Name: cytochrome c oxidase subunit VIa polypeptide 1
  Uniprot ID: P12074
  ENSP ID: ENSP00000229379
MAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 21823 - protein, 97 aa, Homo sapiens
  Payload ID: 4403
  Gene Symbol: COX6A2
  Gene Name: cytochrome c oxidase subunit VIa polypeptide 2
  Uniprot ID: Q02221
  ENSP ID: ENSP00000287490
MALPLRPLTRGLASAAKGGHGGAGARTWRLLTFVLALPSVALCTFNSYLHSGHRPRPEFRPYQHLRIRTKPYPWGDGNHTLFHNSHVNPLPTGYEHP

SEQ ID NO: 21824 - protein, 86 aa, Homo sapiens
  Payload ID: 4404
  Gene Symbol: COX6B1
  Gene Name: cytochrome c oxidase subunit VIb polypeptide 1 (ubiquitous)
  Uniprot ID: P14854
  ENSP ID: ENSP00000246554
MAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 21825 - protein, 86 aa, Homo sapiens; identical to SEQ ID NO: 21824
  Payload ID: 4404
  Gene Symbol: COX6B1
  Gene Name: cytochrome c oxidase subunit VIb polypeptide 1 (ubiquitous)
  Uniprot ID: P14854
  ENSP ID: ENSP00000376037

SEQ ID NO: 21826 - protein, 86 aa, Homo sapiens; identical to SEQ ID NO: 21824
  Payload ID: 4404
  Gene Symbol: COX6B1
  Gene Name: cytochrome c oxidase subunit VIb polypeptide 1 (ubiquitous)
  Uniprot ID: P14854
  ENSP ID: ENSP00000466818

SEQ ID NO: 21827 - protein, 40 aa, Homo sapiens
  Payload ID: 4404
  Gene Symbol: COX6B1
  Gene Name: cytochrome c oxidase subunit VIb polypeptide 1 (ubiquitous)
  ENSP ID: ENSP00000467776
  MOD_RES (1)..(1): Any amino acid
XAEDMETKIKNYKTAPFDSRFPNQNQTRNCWQNYLGHRLG

SEQ ID NO: 21828 - protein, 88 aa, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENSP ID: ENSP00000320672
MLDVEAQEPPKGKWSTPPFDPRFPSQNQIRNCYQNFLDYHRCLKTRTRRGKSTQPCEYYFRVYHSLCPISWVESWNEQIKNGIFAGKI

SEQ ID NO: 21829 - protein, 88 aa, Homo sapiens; identical to SEQ ID NO: 21828
  Payload ID: 4405
  Gene Symbol: COX6B2
  Gene Name: cytochrome c oxidase subunit VIb polypeptide 2 (testis)
  Uniprot ID: Q6YFQ2
  ENSP ID: ENSP00000467128

SEQ ID NO: 21830 - protein, 88 aa, Homo sapiens; identical to SEQ ID NO: 21828
  Payload ID: 4405
  Gene Symbol: COX6B2
  Gene Name: cytochrome c oxidase subunit VIb polypeptide 2 (testis)
  Uniprot ID: Q6YFQ2
  ENSP ID: ENSP00000467266

SEQ ID NO: 21831 - protein, 88 aa, Homo sapiens; identical to SEQ ID NO: 21828
  Payload ID: 4405
  Gene Symbol: COX6B2
  Gene Name: cytochrome c oxidase subunit VIb polypeptide 2 (testis)
  Uniprot ID: Q6YFQ2
  ENSP ID: ENSP00000467959

SEQ ID NO: 21832 - protein, 88 aa, Homo sapiens; identical to SEQ ID NO: 21828
  Payload ID: 4405
  Gene Symbol: COX6B2
  Gene Name: cytochrome c oxidase subunit VIb polypeptide 2 (testis)
  Uniprot ID: Q6YFQ2
  ENSP ID: ENSP00000476768

SEQ ID NO: 21833 - protein, 75 aa, Homo sapiens
  Payload ID: 4406
  Gene Symbol: COX6C
  Gene Name: cytochrome c oxidase subunit VIc
  Uniprot ID: P09669
  ENSP ID: ENSP00000297564
MAPEVLPKPRMRGLLARRLRNHMAVAFVLSLGVAALYKFRVADQRKKAYADFYRNYDVMKDFEEMRKAGIFQSVK

SEQ ID NO: 21834 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000428150

SEQ ID NO: 21835 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000428702

SEQ ID NO: 21836 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000428895

SEQ ID NO: 21837 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000428965

SEQ ID NO: 21838 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000429410

SEQ ID NO: 21839 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000429707

SEQ ID NO: 21840 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000429714

SEQ ID NO: 21841 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000429755

SEQ ID NO: 21842 - protein, 75 aa, Homo sapiens; identical to SEQ ID NO: 21833
  Payload ID: 4406
  Gene Symbol: COX6C
  Gene Name: cytochrome c oxidase subunit VIc
  Uniprot ID: P09669
  ENSP ID: ENSP00000429991

SEQ ID NO: 21843 - protein, 79 aa, Homo sapiens
  Payload ID: 4407
  Gene Symbol: COX7A1
  Gene Name: cytochrome c oxidase subunit VIIa polypeptide 1 (muscle)
  Uniprot ID: P24310
  ENSP ID: ENSP00000292907
MQALRVSQALIRSFSSTARNRFQNRVREKQKLFQEDNDIPLYLKGGIVDNILYRVTMTLCLGGTVYSLYSLGWASFPRN

SEQ ID NO: 21844 - protein, 60 aa, Homo sapiens
  Payload ID: 4407
  Gene Symbol: COX7A1
  Gene Name: cytochrome c oxidase subunit VIIa polypeptide 1 (muscle)
  ENSP ID: ENSP00000468063
MQALRVSQALIRSFSSTARNRFQNREDNDIPLYLKGGIVDNILYRVTMTLCLGGTVYSLY

SEQ ID NO: 21845 - protein, 23 aa, Homo sapiens
  Payload ID: 4407
  Gene Symbol: COX7A1
  Gene Name: cytochrome c oxidase subunit VIIa polypeptide 1 (muscle)
  ENSP ID: ENSP00000475885
MTLCLGGTVYSLYSLGWASFPRN

SEQ ID NO: 21846 - protein, 115 aa, Homo sapiens
  Payload ID: 4408
  Gene Symbol: COX7A2
  Gene Name: cytochrome c oxidase subunit VIIa polypeptide 2 (liver)
  ENSP ID: ENSP00000359098
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGTAYAIYELAVASFPKKQE

SEQ ID NO: 21847 - protein, 115 aa, Homo sapiens; identical to SEQ ID NO: 21846
  Payload ID: 4408
  Gene Symbol: COX7A2
  Gene Name: cytochrome c oxidase subunit VIIa polypeptide 2 (liver)
  ENSP ID: ENSP00000359106

SEQ ID NO: 21848 - protein, 103 aa, Homo sapiens
  Payload ID: 4408
  Gene Symbol: COX7A2
  Gene Name: cytochrome c oxidase subunit VIIa polypeptide 2 (liver)
  ENSP ID: ENSP00000421193
MLRNLLFHTCCPGWSAMARSQLTATSASQVQAILLPQPPKYLGLQALRQIGQRTISTASRRHFKNKVPEKQKLFQEDDEIPLYLKGGVADALLYRATMILTVG

SEQ ID NO: 21849 - protein, 67 aa, Homo sapiens
  Payload ID: 4408
  Gene Symbol: COX7A2
  Gene Name: cytochrome c oxidase subunit VIIa polypeptide 2 (liver)
  ENSP ID: ENSP00000421969
  MOD_RES (1)..(1): Any amino acid
XFSLVVFSCGGCWSVTAKMLRNLLALRQIGQRTISTASRRHFKNKVPEKQKLFQVLKYFIGDVTCNY

SEQ ID NO: 21850 - protein, 53 aa, Homo sapiens
  Payload ID: 4408
  Gene Symbol: COX7A2
  Gene Name: cytochrome c oxidase subunit VIIa polypeptide 2 (liver)
  ENSP ID: ENSP00000422979
MLRNLLEDDEIPLYLKGGVADALLYRATMILTVGGTAYAIYELAVASFPKKQE

SEQ ID NO: 21851 - protein, 76 aa, Homo sapiens
  Payload ID: 4408
  Gene Symbol: COX7A2
  Gene Name: cytochrome c oxidase subunit VIIa polypeptide 2 (liver)
  ENSP ID: ENSP00000423432
MLRNLLALRQIGQRTISTASRRHFKNKVPEKQKLFQEQHMPYMSWLWLHFPRSRSDFSHPSNRLVQFHSALYGPVI

SEQ ID NO: 21852 - protein, 91 aa, Homo sapiens
  Payload ID: 4408
  Gene Symbol: COX7A2
  Gene Name: cytochrome c oxidase subunit VIIa polypeptide 2 (liver)
  ENSP ID: ENSP00000425951
MLRNLLALRQIGQRTISTASRRHFKNKVPEKQKLFQEDDEIPLYLKGGVADALLYRATMILTVGGKAFGMFEGTAYAIYELAVASFPKKQE

SEQ ID NO: 21853 - protein, 114 aa, Homo sapiens
  Payload ID: 4409
  Gene Symbol: COX7A2L
  Gene Name: cytochrome c oxidase subunit VIIa polypeptide 2 like
  Uniprot ID: O14548
  ENSP ID: ENSP00000234301
MYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 21854 - protein, 114 aa, Homo sapiens; identical to SEQ ID NO: 21853
  Payload ID: 4409
  Gene Symbol: COX7A2L
  Gene Name: cytochrome c oxidase subunit VIIa polypeptide 2 like
  Uniprot ID: O14548
  ENSP ID: ENSP00000367938

SEQ ID NO: 21855 - protein, 39 aa, Homo sapiens
  Payload ID: 4409
  Gene Symbol: COX7A2L
  Gene Name: cytochrome c oxidase subunit VIIa polypeptide 2 like
  ENSP ID: ENSP00000428873
MYYKFSGFTQKLAGAWASEAYSPQVRVAPGQLGHEKWRP

SEQ ID NO: 21856 - protein, 95 aa, Homo sapiens
  Payload ID: 4409
  Gene Symbol: COX7A2L
  Gene Name: cytochrome c oxidase subunit VIIa polypeptide 2 like
  ENSP ID: ENSP00000429237
FSGFTQKLAGAWASEAYSPQGLKPVVSTEAPPIIFATPTKLTSDSTVYDYAGKNKVPELQKFFQETYLQTILFLWLLETPVVGILDKGTFPAGLQ

SEQ ID NO: 21857 - protein, 79 aa, Homo sapiens
  Payload ID: 4409
  Gene Symbol: COX7A2L
  Gene Name: cytochrome c oxidase subunit VIIa polypeptide 2 like
  ENSP ID: ENSP00000431039
MYYKFSGFTQKLAGAWASEAYSPQGLKPVVSTEAPPIIFATPTKLTSDSTVYDYAGKNKVPELQKFFQVREDTLQQKSL

SEQ ID NO: 21858 - protein, 80 aa, Homo sapiens
  Payload ID: 4410
  Gene Symbol: COX7B
  Gene Name: cytochrome c oxidase subunit VIIb
  Uniprot ID: P24311
  ENSP ID: ENSP00000417656
MFPLVKSALNRLQVRSIQQTMARQSHQKRTPDFHDKYGNAVLASGATFCIVTWTYVATQVGIEWNLSPVGRVTPKEWRNQ

SEQ ID NO: 21859 - protein, 81 aa, Homo sapiens
  Payload ID: 4411
  Gene Symbol: COX7B2
  Gene Name: cytochrome c oxidase subunit VIIb2
  Uniprot ID: Q8TF08
  ENSP ID: ENSP00000347799
MMFPLARNALSSLKIQSILQSMARHSHVKHSPDFHDKYGNAVLASGTAFCVATWVFTATQIGIEWNLSPVGRVTPKEWKHQ

SEQ ID NO: 21860 - protein, 81 aa, Homo sapiens; identical to SEQ ID NO: 21859
  Payload ID: 4411
  Gene Symbol: COX7B2
  Gene Name: cytochrome c oxidase subunit VIIb2
  Uniprot ID: Q8TF08
  ENSP ID: ENSP00000379784

SEQ ID NO: 21861 - protein, 32 aa, Homo sapiens
  Payload ID: 4411
  Gene Symbol: COX7B2
  Gene Name: cytochrome c oxidase subunit VIIb2
  ENSP ID: ENSP00000423519
MMFPLARNALSSLKIQSILQSMARHSHVKHSP

SEQ ID NO: 21862 - protein, 80 aa, Homo sapiens
  Payload ID: 4411
  Gene Symbol: COX7B2
  Gene Name: cytochrome c oxidase subunit VIIb2
  ENSP ID: ENSP00000437439
MFPLARNALSSLKIQSILQSMARHSHVKHSPDFHDKYGNAVLASGTAFCVATWVFTATQIGIEWNLSPVGRVTPKEWKHQ

SEQ ID NO: 21863 - protein, 63 aa, Homo sapiens
  Payload ID: 4412
  Gene Symbol: COX7C
  Gene Name: cytochrome c oxidase subunit VIIc
  Uniprot ID: P15954
  ENSP ID: ENSP00000247655
MLGQSIRRFTTSVVRRSHYEEGPGKNLPFSVENKWSLLAKMCLYFGSAFATPFLVVRHQLLKT

SEQ ID NO: 21864 - protein, 56 aa, Homo sapiens
  Payload ID: 4412
  Gene Symbol: COX7C
  Gene Name: cytochrome c oxidase subunit VIIc
  ENSP ID: ENSP00000422012
MLGQSIRRFTTSVVRRSHYEEGPGKNLPFSVENKWSLLAKMCLYFGSAFATPFLVI

SEQ ID NO: 21865 - protein, 63 aa, Homo sapiens; identical to SEQ ID NO: 21863
  Payload ID: 4412
  Gene Symbol: COX7C
  Gene Name: cytochrome c oxidase subunit VIIc
  Uniprot ID: P15954
  ENSP ID: ENSP00000425759

SEQ ID NO: 21866 - protein, 69 aa, Homo sapiens
  Payload ID: 4413
  Gene Symbol: COX8A
  Gene Name: cytochrome c oxidase subunit VIIIA (ubiquitous)
  Uniprot ID: P10176
  ENSP ID: ENSP00000321260
MSVLTPLLLRGLTGSARRLPVPRAKIHSLPPEGKLGIMELAVGLTSCFVTFLLPAGWILSHLETYRRPE

SEQ ID NO: 21867 - protein, 72 aa, Homo sapiens
  Payload ID: 4414
  Gene Symbol: COX8C
  Gene Name: cytochrome c oxidase subunit VIIIC
  Uniprot ID: Q7Z4L0
  ENSP ID: ENSP00000340568
MPLLRGRCPARRHYRRLALLGLQPAPRFAHSGPPRQRPLSAAEMAVGLVVFFTTFLTPAAYVLGNLKQFRRN

SEQ ID NO: 21868 - protein, 72 aa, Homo sapiens; identical to SEQ ID NO: 21867
  Payload ID: 4414
  Gene Symbol: COX8C
  Gene Name: cytochrome c oxidase subunit VIIIC
  Uniprot ID: Q7Z4L0
  ENSP ID: ENSP00000480706

SEQ ID NO: 21869 - protein, 105 aa, Homo sapiens
  Payload ID: 4415
  Gene Symbol: CYCS
  Gene Name: cytochrome c, somatic
  Uniprot ID: P99999
  ENSP ID: ENSP00000307786
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 21870 - protein, 105 aa, Homo sapiens; identical to SEQ ID NO: 21869
  Payload ID: 4415
  Gene Symbol: CYCS
  Gene Name: cytochrome c, somatic
  Uniprot ID: P99999
  ENSP ID: ENSP00000386270

SEQ ID NO: 21871 - protein, 105 aa, Homo sapiens; identical to SEQ ID NO: 21869
  Payload ID: 4415
  Gene Symbol: CYCS
  Gene Name: cytochrome c, somatic
  Uniprot ID: P99999
  ENSP ID: ENSP00000387279

SEQ ID NO: 21872 - protein, 101 aa, Homo sapiens
  Payload ID: 4415
  Gene Symbol: CYCS
  Gene Name: cytochrome c, somatic
  ENSP ID: ENSP00000416479
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKK

SEQ ID NO: 21873 - protein, 325 aa, Homo sapiens
  Payload ID: 4416
  Gene Symbol: CYC1
  Gene Name: cytochrome c-1
  Uniprot ID: P08574
  ENSP ID: ENSP00000317159
MAAAAASLRGVVLGPRGAGLPGARARGLLCSARPGQLPLRTPQAVALSSKSGLSRGRKVMLSALGMLAAGGAGLAMALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 21874 - protein, 512 aa, Homo sapiens [sequence omitted]

SEQ ID NO: 21875 - protein, 512 aa, Homo sapiens [sequence omitted]

SEQ ID NO: 21876 - protein, 483 aa, Homo sapiens
  Payload ID: 4417
  Gene Symbol: CYP1A1
  Gene Name: cytochrome P450, family 1, subfamily A, polypeptide 1
  ENSP ID: ENSP00000378489
MLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNNNFGEVVGSGNPADFIPILRYLPNPSLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHRKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 21877 - protein, 189 aa, Homo sapiens
  Payload ID: 4417
  Gene Symbol: CYP1A1
  Gene Name: cytochrome P450, family 1, subfamily A, polypeptide 1
  Uniprot ID: P04798
  ENSP ID: ENSP00000455051
MLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRT

SEQ ID NO: 21878 - protein, 189 aa, Homo sapiens; identical to SEQ ID NO: 21877
  Payload ID: 4417
  Gene Symbol: CYP1A1
  Gene Name: cytochrome P450, family 1, subfamily A, polypeptide 1
  Uniprot ID: P04798
  ENSP ID: ENSP00000455340

SEQ ID NO: 21879 - protein, 175 aa, Homo sapiens
  Payload ID: 4417
  Gene Symbol: CYP1A1
  Gene Name: cytochrome P450, family 1, subfamily A, polypeptide 1
  ENSP ID: ENSP00000455846
MQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPD

SEQ ID NO: 21880 - protein, 512 aa, Homo sapiens [sequence omitted]

SEQ ID NO: 21881 - protein, 157 aa, Homo sapiens
  Payload ID: 4417
  Gene Symbol: CYP1A1
  Gene Name: cytochrome P450, family 1, subfamily A, polypeptide 1
  Uniprot ID: P04798
  ENSP ID: ENSP00000457668
MQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQ

SEQ ID NO: 21882 - protein, 484 aa, Homo sapiens
  Payload ID: 4417
  Gene Symbol: CYP1A1
  Gene Name: cytochrome P450, family 1, subfamily A, polypeptide 1
  ENSP ID: ENSP00000479744
MLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 21883 - protein, 483 aa, Homo sapiens; identical to SEQ ID NO: 21876
  Payload ID: 4417
  Gene Symbol: CYP1A1
  Gene Name: cytochrome P450, family 1, subfamily A, polypeptide 1
  ENSP ID: ENSP00000482863

SEQ ID NO: 21884 - protein, 516 aa, Homo sapiens
  Payload ID: 4418
  Gene Symbol: CYP1A2
  Gene Name: cytochrome P450, family 1, subfamily A, polypeptide 2
  Uniprot ID: P05177
  ENSP ID: ENSP00000342007
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 21885 - protein, 543 aa, Homo sapiens
  Payload ID: 4419
  Gene Symbol: CYP1B1
  Gene Name: cytochrome P450, family 1, subfamily B, polypeptide 1
  Uniprot ID: Q16678
  ENSP ID: ENSP00000478561
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 21886 - protein, 143 aa, Homo sapiens
  Payload ID: 4419
  Gene Symbol: CYP1B1
  Gene Name: cytochrome P450, family 1, subfamily B, polypeptide 1
  ENSP ID: ENSP00000478839
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKV

SEQ ID NO: 21887 - protein, 172 aa, Homo sapiens
  Payload ID: 4419
  Gene Symbol: CYP1B1
  Gene Name: cytochrome P450, family 1, subfamily B, polypeptide 1
  ENSP ID: ENSP00000479876
MGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 21888 - protein, 543 aa, Homo sapiens; identical to SEQ ID NO: 21885
  Payload ID: 4419
  Gene Symbol: CYP1B1
  Gene Name: cytochrome P450, family 1, subfamily B, polypeptide 1
  Uniprot ID: Q16678
  ENSP ID: ENSP00000483678

SEQ ID NO: 21889 - protein, 521 aa, Homo sapiens
  Payload ID: 4420
  Gene Symbol: CYP11A1
  Gene Name: cytochrome P450, family 11, subfamily A, polypeptide 1
  Uniprot ID: P05108
  ENSP ID: ENSP00000268053
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 21890 - protein, 363 aa, Homo sapiens
  Payload ID: 4420
  Gene Symbol: CYP11A1
  Gene Name: cytochrome P450, family 11, subfamily A, polypeptide 1
  Uniprot ID: P05108
  ENSP ID: ENSP00000351455
MAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 21891 - protein, 168 aa, Homo sapiens
  Payload ID: 4420
  Gene Symbol: CYP11A1
  Gene Name: cytochrome P450, family 11, subfamily A, polypeptide 1
  ENSP ID: ENSP00000388018
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKPGVCDHEGLWAHVFSGSRQPGRKTGW

SEQ ID NO: 21892 - protein, 414 aa, Homo sapiens
  Payload ID: 4420
  Gene Symbol: CYP11A1
  Gene Name: cytochrome P450, family 11, subfamily A, polypeptide 1
  ENSP ID: ENSP00000391081
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRHWCKWPSMLWAESPPSSSTRKILTQPDG

SEQ ID NO: 21893 - protein, 96 aa, Homo sapiens
  Payload ID: 4420
  Gene Symbol: CYP11A1
  Gene Name: cytochrome P450, family 11, subfamily A, polypeptide 1
  ENSP ID: ENSP00000402064
MAPEATKNFLPLLDAVSRDFVSVLHRRIKKAGSGNYSGDISDDLFRFAFESITNVIFGERQGMLEEVVNPEAQRFIDAIYQMFHTSVPMLNLPPDL

SEQ ID NO: 21894 - protein, 26 aa, Homo sapiens
  Payload ID: 4420
  Gene Symbol: CYP11A1
  Gene Name: cytochrome P450, family 11, subfamily A, polypeptide 1
  ENSP ID: ENSP00000456598
MAPEATKNFLPLLDAVSRDFVSVLHR

SEQ ID NO: 21895 - protein, 227 aa, Homo sapiens
  Payload ID: 4420
  Gene Symbol: CYP11A1
  Gene Name: cytochrome P450, family 11, subfamily A, polypeptide 1
  ENSP ID: ENSP00000456941
MAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETL

SEQ ID NO: 21896 - protein, 503 aa, Homo sapiens
  Payload ID: 4421
  Gene Symbol: CYP11B1
  Gene Name: cytochrome P450, family 11, subfamily B, polypeptide 1
  Uniprot ID: P15538
  ENSP ID: ENSP00000292427
MALRAKAEVCMAVPWLSLQRAQALGTRAARVPRTVLPFEAMPRRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVASSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 21897 - protein, 574 aa, Homo sapiens
  Payload ID: 4421
  Gene Symbol: CYP11B1
  Gene Name: cytochrome P450, family 11, subfamily B, polypeptide 1
  ENSP ID: ENSP00000366903
MALRAKAEVCMAVPWLSLQRAQALGTRAARVPRTVLPFEAMPRRPGNRWLRLLQIWREQGYEDLHLEVHQTFQELGPIFRSRHSASFGRWGRSAARAGLWRCQGRGWCRANPSSLQRGQDSEALKYDLGGAGMVCVMLPEDVEKLQQVDSLHPHRMSLEPWVAYRQHRGHKCGVFLLNVADRGNSSPPFPGGIHGAPTHSGCRNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVASSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 21898 - protein, 437 aa, Homo sapiens
  Payload ID: 4421
  Gene Symbol: CYP11B1
  Gene Name: cytochrome P450, family 11, subfamily B, polypeptide 1
  Uniprot ID: P15538
  ENSP ID: ENSP00000428043
MALRAKAEVCMAVPWLSLQRAQALGTRAARVPRTVLPFEAMPRRPGNRWLRLLQIWREQGYEDLHLEVHQTFQELGPIFRYDLGGAGMVCVMLPEDVEKLQQVDSLHPHRMSLEPWVAYRQHRGHKCGVFLLNGPEWRFNRLRLNPEVLSPNAVQRFLPMVDAVARDFSQALKKKVLQNARGSLTLDVQPSIFHYTIEASNLALFGERLGLVGHSPSSASLNFLHALEVMFKSTVQLMFMPRSLSRWTSPKVWKEHFEAWDCIFQYGDNCIQKIYQELAFSRPQQYTSIVAELLLNAELSPDAIKANSMELTAGSVDTTVFPLLMTLFELARNPNVQQALRQESLAAAASISEHPQKATTELPLLRAALKETLRLYPVGLFLERVASSDLVLQNYHIPAGVLKHLQVETLTQEDIKMVYSFILRPSMFPLLTFRAIN

SEQ ID NO: 21899 - protein, 181 aa, Homo sapiens
  Payload ID: 4421
  Gene Symbol: CYP11B1
  Gene Name: cytochrome P450, family 11, subfamily B, polypeptide 1
  ENSP ID: ENSP00000430144
AAAASISEHPQKATTELPLLRAALKETLRKGAESTGSPIQLRTLSMDAPTSRLYPVGLFLERVASSDLVLQNYHIPAGTLVRVFLYSLGRNPALFPRPERYNPQRWLDIRGSGRNFYHVPFGFGMRQCLGRRLAEAEMLLLLHHVLKHLQVETLTQEDIKMVYSFILRPSMFPLLTFRAIN

SEQ ID NO: 21900 - protein, 503 aa, Homo sapiens
  Payload ID: 4422
  Gene Symbol: CYP11B2
  Gene Name: cytochrome P450, family 11, subfamily B, polypeptide 2
  Uniprot ID: P19099
  ENSP ID: ENSP00000325822
MALRAKAEVCVAAPWLSLQRARALGTRAARAPRTVLPFEAMPQHPGNRWLRLLQIWREQGYEHLHLEMHQTFQELGPIFRYNLGGPRMVCVMLPEDVEKLQQVDSLHPCRMILEPWVAYRQHRGHKCGVFLLNGPEWRFNRLRLNPDVLSPKAVQRFLPMVDAVARDFSQALKKKVLQNARGSLTLDVQPSIFHYTIEASNLALFGERLGLVGHSPSSASLNFLHALEVMFKSTVQLMFMPRSLSRWISPKVWKEHFEAWDCIFQYGDNCIQKIYQELAFNRPQHYTGIVAELLLKAELSLEAIKANSMELTAGSVDTTAFPLLMTLFELARNPDVQQILRQESLAAAASISEHPQKATTELPLLRAALKETLRLYPVGLFLERVVSSDLVLQNYHIPAGTLVQVFLYSLGRNAALFPRPERYNPQRWLDIRGSGRNFHHVPFGFGMRQCLGRRLAEAEMLLLLHHVLKHFLVETLTQEDIKMVYSFILRPGTSPLLTFRAIN

SEQ ID NO: 21901 - protein, 508 aa, Homo sapiens
  Payload ID: 4423
  Gene Symbol: CYP17A1
  Gene Name: cytochrome P450, family 17, subfamily A, polypeptide 1
  Uniprot ID: P05093
  ENSP ID: ENSP00000358903
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 21902 - protein, 503 aa, Homo sapiens
  Payload ID: 4424
  Gene Symbol: CYP19A1
  Gene Name: cytochrome P450, family 19, subfamily A, polypeptide 1
  Uniprot ID: P11511
  ENSP ID: ENSP00000260433
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 21903 - protein, 503 aa, Homo sapiens; identical to SEQ ID NO: 21902
  Payload ID: 4424
  Gene Symbol: CYP19A1
  Gene Name: cytochrome P450, family 19, subfamily A, polypeptide 1
  Uniprot ID: P11511
  ENSP ID: ENSP00000379683

SEQ ID NO: 21904 - protein, 503 aa, Homo sapiens; identical to SEQ ID NO: 21902
  Payload ID: 4424
  Gene Symbol: CYP19A1
  Gene Name: cytochrome P450, family 19, subfamily A, polypeptide 1
  Uniprot ID: P11511
  ENSP ID: ENSP00000379685

SEQ ID NO: 21905 - protein, 218 aa, Homo sapiens
  Payload ID: 4424
  Gene Symbol: CYP19A1
  Gene Name: cytochrome P450, family 19, subfamily A, polypeptide 1
  Uniprot ID: P11511
  ENSP ID: ENSP00000383930
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDGTEIFTLTS

SEQ ID NO: 21906 - protein, 166 aa, Homo sapiens
  Payload ID: 4424
  Gene Symbol: CYP19A1
  Gene Name: cytochrome P450, family 19, subfamily A, polypeptide 1
  ENSP ID: ENSP00000384389
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAE

SEQ ID NO: 21907 - protein, 352 aa, Homo sapiens
  Payload ID: 4424
  Gene Symbol: CYP19A1
  Gene Name: cytochrome P450, family 19, subfamily A, polypeptide 1
  ENSP ID: ENSP00000390614
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQK

SEQ ID NO: 21908 - protein, 242 aa, Homo sapiens
  Payload ID: 4424
  Gene Symbol: CYP19A1
  Gene Name: cytochrome P450, family 19, subfamily A, polypeptide 1
  ENSP ID: ENSP00000391139
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYK

SEQ ID NO: 21909 - protein, 218 aa, Homo sapiens; identical to SEQ ID NO: 21905
  Payload ID: 4424
  Gene Symbol: CYP19A1
  Gene Name: cytochrome P450, family 19, subfamily A, polypeptide 1
  Uniprot ID: P11511
  ENSP ID: ENSP00000452627

SEQ ID NO: 21910 - protein, 138 aa, Homo sapiens
  Payload ID: 4424
  Gene Symbol: CYP19A1
  Gene Name: cytochrome P450, family 19, subfamily A, polypeptide 1
  ENSP ID: ENSP00000452667
  MOD_RES (1)..(1): Any amino acid
XDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVRALP

SEQ ID NO: 21911 - protein, 172 aa, Homo sapiens
  Payload ID: 4424
  Gene Symbol: CYP19A1
  Gene Name: cytochrome P450, family 19, subfamily A, polypeptide 1
  ENSP ID: ENSP00000452872
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHL

SEQ ID NO: 21912 - protein, 503 aa, Homo sapiens; identical to SEQ ID NO: 21902
  Payload ID: 4424
  Gene Symbol: CYP19A1
  Gene Name: cytochrome P450, family 19, subfamily A, polypeptide 1
  Uniprot ID: P11511
  ENSP ID: ENSP00000453149

SEQ ID NO: 21913 - protein, 283 aa, Homo sapiens
  Payload ID: 4424
  Gene Symbol: CYP19A1
  Gene Name: cytochrome P450, family 19, subfamily A, polypeptide 1
  ENSP ID: ENSP00000453280
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELI

SEQ ID NO: 21914 - protein, 164 aa, Homo sapiens
  Payload ID: 4424
  Gene Symbol: CYP19A1
  Gene Name: cytochrome P450, family 19, subfamily A, polypeptide 1
  ENSP ID: ENSP00000453318
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVC

SEQ ID NO: 21915 - protein, 352 aa, Homo sapiens; identical to SEQ ID NO: 21907
  Payload ID: 4424
  Gene Symbol: CYP19A1
  Gene Name: cytochrome P450, family 19, subfamily A, polypeptide 1
  ENSP ID: ENSP00000454004

SEQ ID NO: 21916 - protein, 244 aa, Homo sapiens
  Payload ID: 4424
  Gene Symbol: CYP19A1
  Gene Name: cytochrome P450, family 19, subfamily A, polypeptide 1
  ENSP ID: ENSP00000454039
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKESAIVVKIQGYFDAWQALLIKPDIFFKISWLYKKYEKSVKDLKDAIEVLIAEKRRRISTEEKLEECMDFATELILAEKRGDLTRENVNQCILEM

SEQ ID NO: 21917 - protein, 41 aa, Homo sapiens
  Payload ID: 4424
  Gene Symbol: CYP19A1
  Gene Name: cytochrome P450, family 19, subfamily A, polypeptide 1
  ENSP ID: ENSP00000479587
KSVVIQLWKIYEYNWIGFFPLCLCCFSWPLSKDLKDAIEVL

SEQ ID NO: 21918 - protein, 494 aa, Homo sapiens
  Payload ID: 4425
  Gene Symbol: CYP2A13
  Gene Name: cytochrome P450, family 2, subfamily A, polypeptide 13
  Uniprot ID: Q16696
  ENSP ID: ENSP00000332679
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 21919 - protein, 494 aa, Homo sapiens
  Payload ID: 4426
  Gene Symbol: CYP2A6
  Gene Name: cytochrome P450, family 2, subfamily A, polypeptide 6
  Uniprot ID: P11509
  ENSP ID: ENSP00000301141
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVYPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 21920 - protein, 65 aa, Homo sapiens
  Payload ID: 4426
  Gene Symbol: CYP2A6
  Gene Name: cytochrome P450, family 2, subfamily A, polypeptide 6
  ENSP ID: ENSP00000472905
MLASGMLLVALLVCLTVMVLMSVWQQRKSKGKLPPGPTPLPFIGNYLQLNTEQMYNSLMKVSQDQ

SEQ ID NO: 21921 - protein, 494 aa, Homo sapiens
  Payload ID: 4426
  Gene Symbol: CYP2A6
  Gene Name: cytochrome P450, family 2, subfamily A, polypeptide 6
  ENSP ID: ENSP00000477899
MLASGLLLVALLACLTVMVLMSVWQQRKSRGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVYPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 21922 - protein, 443 aa, Homo sapiens
  Payload ID: 4427
  Gene Symbol: CYP2A7
  Gene Name: cytochrome P450, family 2, subfamily A, polypeptide 7
  ENSP ID: ENSP00000291764
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 21923 - protein, 494 aa, Homo sapiens
  Payload ID: 4427
  Gene Symbol: CYP2A7
  Gene Name: cytochrome P450, family 2, subfamily A, polypeptide 7
  Uniprot ID: P20853
  ENSP ID: ENSP00000301146
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 21924 - protein, 80 aa, Homo sapiens
  Payload ID: 4427
  Gene Symbol: CYP2A7
  Gene Name: cytochrome P450, family 2, subfamily A, polypeptide 7
  ENSP ID: ENSP00000470933
MLASGLLLVALLACLTVMVLMSVWQQRKSRGKLPPGPTPLPFIGNYLQLNTEHICDSIMKAWRSATGSAPSSSCALPSPP

SEQ ID NO: 21925 - protein, 491 aa, Homo sapiens
  Payload ID: 4428
  Gene Symbol: CYP2B6
  Gene Name: cytochrome P450, family 2, subfamily B, polypeptide 6
  Uniprot ID: P20813
  ENSP ID: ENSP00000324648
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 21926 - protein, 255 aa, Homo sapiens
  Payload ID: 4428
  Gene Symbol: CYP2B6
  Gene Name: cytochrome P450, family 2, subfamily B, polypeptide 6
  ENSP ID: ENSP00000470582
MLCGVEAIREALVDKAEAFSGRGKIAMVDPFFRGYGVIFANGNRWKVLRRFSVTTMRDFGMGKRSVEERIQEEAQCLIEELRKSKERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 21927 - protein, 490 aa, Homo sapiens
  Payload ID: 4429
  Gene Symbol: CYP2C18
  Gene Name: cytochrome P450, family 2, subfamily C, polypeptide 18
  Uniprot ID: P33260
  ENSP ID: ENSP00000285979
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 21928 - protein, 431 aa, Homo sapiens
  Payload ID: 4429
  Gene Symbol: CYP2C18
  Gene Name: cytochrome P450, family 2, subfamily C, polypeptide 18
  Uniprot ID: P33260
  ENSP ID: ENSP00000341293
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 21929 - protein, 490 aa, Homo sapiens
  Payload ID: 4430
  Gene Symbol: CYP2C19
  Gene Name: cytochrome P450, family 2, subfamily C, polypeptide 19
  Uniprot ID: P33261
  ENSP ID: ENSP00000360372
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVIGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 21930 - protein, 162 aa, Homo sapiens
  Payload ID: 4430
  Gene Symbol: CYP2C19
  Gene Name: cytochrome P450, family 2, subfamily C, polypeptide 19
  ENSP ID: ENSP00000483847
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKGG

SEQ ID NO: 21931 - protein, 490 aa, Homo sapiens
  Payload ID: 4431
  Gene Symbol: CYP2C8
  Gene Name: cytochrome P450, family 2, subfamily C, polypeptide 8
  Uniprot ID: P10632
  ENSP ID: ENSP00000360317
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 21932 - protein, 393 aa, Homo sapiens
  Payload ID: 4431
  Gene Symbol: CYP2C8
  Gene Name: cytochrome P450, family 2, subfamily C, polypeptide 8
  ENSP ID: ENSP00000433191
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 21933 - protein, 83 aa, Homo sapiens
  Payload ID: 4431
  Gene Symbol: CYP2C8
  Gene Name: cytochrome P450, family 2, subfamily C, polypeptide 8
  ENSP ID: ENSP00000433314
MEPFVVLVLCLSFMLLFSLWRQSCRRRKLPPGPTPLPIIGNMLQIDVKDICKSFTNVSLPYVPPANCKGSQKSMVLCSPCILA

SEQ ID NO: 21934 - protein, 99 aa, Homo sapiens
  Payload ID: 4431
  Gene Symbol: CYP2C8
  Gene Name: cytochrome P450, family 2, subfamily C, polypeptide 8
  ENSP ID: ENSP00000433842
MEPFVVLVLCLSFMLLFSLWRQSCRRRKLPPGPTPLPIIGNMLQIDVKDICKSFTNVSLPYVPPANCKGNHFQQWKEMEGDPAFLPHNLAEFWDGEEEH

SEQ ID NO: 21935 - protein, 420 aa, Homo sapiens
  Payload ID: 4431
  Gene Symbol: CYP2C8
  Gene Name: cytochrome P450, family 2, subfamily C, polypeptide 8
  ENSP ID: ENSP00000442343
MNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 21936 - protein, 388 aa, Homo sapiens
  Payload ID: 4431
  Gene Symbol: CYP2C8
  Gene Name: cytochrome P450, family 2, subfamily C, polypeptide 8
  Uniprot ID: P10632
  ENSP ID: ENSP00000445062
MFLQPIAKGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 21937 - protein, 420 aa, Homo sapiens; identical to SEQ ID NO: 21935
  Payload ID: 4431
  Gene Symbol: CYP2C8
  Gene Name: cytochrome P450, family 2, subfamily C, polypeptide 8
  ENSP ID: ENSP00000485110

SEQ ID NO: 21938 - protein, 307 aa, Homo sapiens
  Payload ID: 4431
  Gene Symbol: CYP2C8
  Gene Name: cytochrome P450, family 2, subfamily C, polypeptide 8
  ENSP ID: ENSP00000487145
MAAKCCSTFFLGCEFSQFLPLFLLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 21939 - protein, 490 aa, Homo sapiens [sequence omitted]

SEQ ID NO: 21940 - protein, 446 aa, Homo sapiens
  Payload ID: 4433
  Gene Symbol: CYP2D6
  Gene Name: cytochrome P450, family 2, subfamily D, polypeptide 6
  Uniprot ID: P10635
  ENSP ID: ENSP00000351927
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVSPSPYELCAVPR

SEQ ID NO: 21941 - protein, 180 aa, Homo sapiens
  Payload ID: 4433
  Gene Symbol: CYP2D6
  Gene Name: cytochrome P450, family 2, subfamily D, polypeptide 6
  ENSP ID: ENSP00000353241
LRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKWWLTCSLPGW

SEQ ID NO: 21942 - protein, 497 aa, Homo sapiens [sequence omitted]

SEQ ID NO: 21943 - protein, 494 aa, Homo sapiens [sequence omitted]

SEQ ID NO: 21944 - protein, 497 aa, Homo sapiens; identical to SEQ ID NO: 1193
  Payload ID: 4433
  Gene Symbol: CYP2D6
  Gene Name: cytochrome P450, family 2, subfamily D, polypeptide 6
  ENSP ID: ENSP00000476021

SEQ ID NO: 21945 - protein, 497 aa, Homo sapiens
  Payload ID: 4433
  Gene Symbol: CYP2D6
  Gene Name: cytochrome P450, family 2, subfamily D, polypeptide 6
  ENSP ID: ENSP00000479867
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 21946 - protein, 446 aa, Homo sapiens; identical to SEQ ID NO: 1192
  Payload ID: 4433
  Gene Symbol: CYP2D6
  Gene Name: cytochrome P450, family 2, subfamily D, polypeptide 6
  ENSP ID: ENSP00000483245

SEQ ID NO: 21947 - protein, 446 aa, Homo sapiens
  Payload ID: 4433
  Gene Symbol: CYP2D6
  Gene Name: cytochrome P450, family 2, subfamily D, polypeptide 6
  Uniprot ID: P10635
  ENSP ID: ENSP00000483677
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 21948 - protein, 497 aa, Homo sapiens; identical to SEQ ID NO: 1193
  Payload ID: 4433
  Gene Symbol: CYP2D6
  Gene Name: cytochrome P450, family 2, subfamily D, polypeptide 6
  ENSP ID: ENSP00000486094

SEQ ID NO: 21949 - protein, 446 aa, Homo sapiens; identical to SEQ ID NO: 1192
  Payload ID: 4433
  Gene Symbol: CYP2D6
  Gene Name: cytochrome P450, family 2, subfamily D, polypeptide 6
  ENSP ID: ENSP00000486619

SEQ ID NO: 21950 - protein, 180 aa, Homo sapiens; identical to SEQ ID NO: 21941
  Payload ID: 4433
  Gene Symbol: CYP2D6
  Gene Name: cytochrome P450, family 2, subfamily D, polypeptide 6
  ENSP ID: ENSP00000487214

SEQ ID NO: 21951 - protein, 180 aa, Homo sapiens; identical to SEQ ID NO: 21941
  Payload ID: 4433
  Gene Symbol: CYP2D6
  Gene Name: cytochrome P450, family 2, subfamily D, polypeptide 6
  ENSP ID: ENSP00000487281

SEQ ID NO: 21952 - protein, 494 aa, Homo sapiens
  Payload ID: 4433
  Gene Symbol: CYP2D6
  Gene Name: cytochrome P450, family 2, subfamily D, polypeptide 6
  ENSP ID: ENSP00000487558
MHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQQGGRVQAGAHPIVGTHVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 21953 - protein, 180 aa, Homo sapiens; identical to SEQ ID NO: 21941
  Payload ID: 4433
  Gene Symbol: CYP2D6
  Gene Name: cytochrome P450, family 2, subfamily D, polypeptide 6
  ENSP ID: ENSP00000488991

SEQ ID NO: 21954 - protein, 446 aa, Homo sapiens; identical to SEQ ID NO: 1192
  Payload ID: 4433
  Gene Symbol: CYP2D6
  Gene Name: cytochrome P450, family 2, subfamily D, polypeptide 6
  ENSP ID: ENSP00000489103

SEQ ID NO: 21955 - protein, 494 aa, Homo sapiens; identical to SEQ ID NO: 21952
  Payload ID: 4433
  Gene Symbol: CYP2D6
  Gene Name: cytochrome P450, family 2, subfamily D, polypeptide 6
  ENSP ID: ENSP00000489144

SEQ ID NO: 21956 - protein, 497 aa, Homo sapiens; identical to SEQ ID NO: 1193
  Payload ID: 4433
  Gene Symbol: CYP2D6
  Gene Name: cytochrome P450, family 2, subfamily D, polypeptide 6
  ENSP ID: ENSP00000489231

SEQ ID NO: 21957 - protein, 45 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000437680
DPAQPPRDLTEAFLAKKEKAKGSPESSFNDENLRIVSVSNRRSTT

SEQ ID NO: 21958 - protein, 505 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000439604
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAARKESVPWVLTHCGDACLSSPCPTGDRRRDRAGAATRDGPGSHALHHCRDSRGAALWGHRPPGCDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAP

SEQ ID NO: 21959 - protein, 486 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000445124
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAAPCPTGDRRRDRAGAATRDGPGSHALHHCRDSRGAALWGHRPPGCDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAP

SEQ ID NO: 21960 - protein, 506 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461363
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAARKESVPWVLTHCGDACLSSPCPTGDRRRDRAGAATRDGPGSHALHHCRDSRGAALWGHHPPECDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAPL

SEQ ID NO: 21961 - protein, 487 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000461768
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAAPCPTGDRRRDRAGAATRDGPGSHALHHCRDSRGAALWGHHPPECDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAPL

SEQ ID NO: 21962 - protein, 446 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478020
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQLRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21963 - protein, 506 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000478656
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGVPVALWARVARAEALLRVHLAQLGPGQEVAGAVGDRGGRLPLCRLRRPSRTPLSPQRSLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAATKESVPWVLTHCGDACLSSPCPTGDRRRDRAGAATRDGPGSHALHHCRDSRGAALWGHHPPECDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAPL

SEQ ID NO: 21964 - protein, 515 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000479001
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQRGRRVSPGCPIVGTHVCPVRVQQEIDDVIGQVRRPEMGDQAHMPCTTAVIHEVQRFGDIIPLSVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21965 - protein, 446 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000480735
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPCTTAVIHEVQRFGDIIPLSVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21966 - protein, 446 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000481168
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPCTTAVIHEVQHFGDIVPLGVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21967 - protein, 515 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000481748
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVFLSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAKKEKAKGSPESSFNDENLRIVVGNLFLAGMVTTLTTLAWGLLLMILHLDVQRRRRVSPGCPIVGTHVCPVRVQQEIDDVIGQVRRPEMGDQAHMPYTTAVIHEVQRFGDIIPLSVTHMTSHDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21968 - protein, 497 aa, Homo sapiens; identical to SEQ ID NO: 1212
  Payload ID: 4434
  Gene Symbol: CYP2D7
  Gene Name: cytochrome P450, family 2, subfamily D, polypeptide 7 (gene/pseudogene)
  ENSP ID: ENSP00000483834

SEQ ID NO: 21969 - protein, 515 aa, Homo sapiens
  Payload ID: 4434
  Gene Symbol: CYP2D7
  Gene Name: cytochrome P450, family 2, subfamily D, polypeptide 7 (gene/pseudogene)
  Uniprot ID: A0A087X1C5
  ENSP ID: ENSP00000484065
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQRGRRVSPGCPIVGTHVCPVRVQQEIDDVIGQVRRPEMGDQAHMPCTTAVIHEVQHFGDIVPLGVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21970 - protein, 45 aa, Homo sapiens; identical to SEQ ID NO: 21957
  Payload ID: 4434
  Gene Symbol: CYP2D7
  Gene Name: cytochrome P450, family 2, subfamily D, polypeptide 7 (gene/pseudogene)
  ENSP ID: ENSP00000484386

SEQ ID NO: 21971 - protein, 487 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000487044
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGVPVALWARVARAEALLRVHLAQLGPGQEVAGAVGDRGGRLPLCRLRRPSRTPLSPQRSLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAAPCPTGDRRRDRAGAATRDGPGSHALHHCRDSRGAALWGHHPPECDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAPL

SEQ ID NO: 21972 - protein, 485 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488911
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAAPCPTGDRRRDRAGAATRDGPGSHALHHCRDSGAALWGHRPPGCDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAP

SEQ ID NO: 21973 - protein, 446 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000488927
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQLRVQQEIDDVIGQVRRPEMGDQAHMPYTTAVIHEVQRFGDIVPLGVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21974 - protein, 504 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489014
MGLEALVPLAMIVAIFLLLVDLMHRHQRWAARYPPGPLPLPGLGNLAACGLPEHTILLRPVAAPLRGRVQPAAGLDAGGRAQWAGGRARGDGDPRRGHGRPPACAHLPGPGLRAAFPRGDPVALWARVARAEALLRVHLAQLGPGQEVAGAVGDRGGRLPLCRLRRPSRTPLSPQRPLGQSREQRDRLPHLRAPLRVRRPSLPQAAGPSSGGTEGGVGLPARGAECCPRPPAHPSAGWQGPTLPKGFPDPAGAANAQDDLGPSPATPRPDGLPGKEGEGQGEPEQLQEPAHSGGPVPCRDGDHLDHAGLGPPAHDPTPGCAARKESVPWVLTHCGDACLSSPCPTGDRRRDRAGAATRDGPGSHALHHCRDSGAALWGHRPPGCDPYDIPHRSTGLPHPGNDTHHQPVIGAEGGRLEEALPLPPRTLPGCPGPLCEAGGLPAFLSRPPCMPRGAPGPHGALPLLHLPAAALQLLRGRRTAPAQPLSCRQLSGDPIPLRALCCAP

SEQ ID NO: 21975 - protein, 45 aa, Homo sapiens; identical to SEQ ID NO: 21957
  Payload ID: 4434
  Gene Symbol: CYP2D7
  Gene Name: cytochrome P450, family 2, subfamily D, polypeptide 7 (gene/pseudogene)
  ENSP ID: ENSP00000489078

SEQ ID NO: 21976 - protein, 515 aa, Homo sapiens
  Payload ID: 4434
  Gene Symbol: CYP2D7
  Gene Name: cytochrome P450, family 2, subfamily D, polypeptide 7 (gene/pseudogene)
  ENSP ID: ENSP00000489459
MGLEALVPLAMIVAIFLLLVDLMHRHQRWAARYPPGPLPLPGLGNLLHVDFQNTPYCFDQLRRRFGDVFSLQLAWTPVVVLNGLAAVREAMVTRGEDTADRPPAPIYQVLGFGPRSQGVILSRYGPAWREQRRFSVSTLRNLGLGKKSLEQWVTEEAACLCAAFADQAGRPFRPNGLLDKAVSNVIASLTCGRRFEYDDPRFLRLLDLAQEGLKEESGFLREVLNAVPVLPHIPALAGKVLRFQKAFLTQLDELLTEHRMTWDPAQPPRDLTEAFLAKKEKAKGSPESSFNDENLRIVVGNLFLAGMVTTSTTLAWGLLLMILHLDVQRGRRVSPGCPIVGTHVCPVRVQQEIDDVIGQVRRPEMGDQAHMPYTTAVIHEVQRFGDIVPLGVTHMTSRDIEVQGFRIPKGTTLITNLSSVLKDEAVWKKPFRFHPEHFLDAQGHFVKPEAFLPFSAGRRACLGEPLARMELFLFFTSLLQHFSFSVAAGQPRPSHSRVVSFLVTPSPYELCAVPR

SEQ ID NO: 21977 - protein, 493 aa, Homo sapiens
  Payload ID: 4435
  Gene Symbol: CYP2E1
  Gene Name: cytochrome P450, family 2, subfamily E, polypeptide 1
  Uniprot ID: P05181
  ENSP ID: ENSP00000252945
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 21978 - protein, 306 aa, Homo sapiens
  Payload ID: 4435
  Gene Symbol: CYP2E1
  Gene Name: cytochrome P450, family 2, subfamily E, polypeptide 1
  ENSP ID: ENSP00000397299
RPFPASHHREPLPVGIEEYSQVLHPGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLA

SEQ ID NO: 21979 - protein, 356 aa, Homo sapiens
  Payload ID: 4435
  Gene Symbol: CYP2E1
  Gene Name: cytochrome P450, family 2, subfamily E, polypeptide 1
  ENSP ID: ENSP00000412754
RPFPASHHREPLPVGIEEYSQVLHPGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLA

SEQ ID NO: 21980 - protein, 86 aa, Homo sapiens
  Payload ID: 4435
  Gene Symbol: CYP2E1
  Gene Name: cytochrome P450, family 2, subfamily E, polypeptide 1
  ENSP ID: ENSP00000437799
MSALGVTVALLVWAAFLLLVSMWRQVHSSWNLPPGPFPLPIIGNLFQLELKNIPKSFTRLAQRFGPVFTLYVGSQRMVVMHGYKAV

SEQ ID NO: 21981 - protein, 493 aa, Homo sapiens; identical to SEQ ID NO: 21977
  Payload ID: 4435
  Gene Symbol: CYP2E1
  Gene Name: cytochrome P450, family 2, subfamily E, polypeptide 1
  Uniprot ID: P05181
  ENSP ID: ENSP00000440689

SEQ ID NO: 21982 - protein, 43 aa, Homo sapiens
  Payload ID: 4435
  Gene Symbol: CYP2E1
  Gene Name: cytochrome P450, family 2, subfamily E, polypeptide 1
  ENSP ID: ENSP00000444958
  MOD_RES (1)..(1): Any amino acid
XGPFPLPIIGNLFQLELKNIPKSFTRESFLIMDLPGRTSGGFP

SEQ ID NO: 21983 - protein, 491 aa, Homo sapiens
  Payload ID: 4436
  Gene Symbol: CYP2F1
  Gene Name: cytochrome P450, family 2, subfamily F, polypeptide 1
  Uniprot ID: P24903
  ENSP ID: ENSP00000333534
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 21984 - protein, 81 aa, Homo sapiens
  Payload ID: 4436
  Gene Symbol: CYP2F1
  Gene Name: cytochrome P450, family 2, subfamily F, polypeptide 1
  ENSP ID: ENSP00000443424
  MOD_RES (1)..(1): Any amino acid
XPHRVTRDTAFRGFLIPKGTDVITLLNTVHYDPSQFLTPQEFNPEHFLDANQSFKKSPAFMPFSAALDAQRHSFLLSTLLL

SEQ ID NO: 21985 - protein, 172 aa, Homo sapiens
  Payload ID: 4436
  Gene Symbol: CYP2F1
  Gene Name: cytochrome P450, family 2, subfamily F, polypeptide 1
  ENSP ID: ENSP00000470136
ARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGEGRNQSLSGPISTYIPHPNSTCQILSLLPSTHSQLWMHRDIHSSSQLCSYRQVVTKILVKQ

SEQ ID NO: 21986 - protein, 320 aa, Homo sapiens
  Payload ID: 4436
  Gene Symbol: CYP2F1
  Gene Name: cytochrome P450, family 2, subfamily F, polypeptide 1
  Uniprot ID: P24903
  ENSP ID: ENSP00000471416
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTPACRRRSTSWWDARGCRR

SEQ ID NO: 21987 - protein, 502 aa, Homo sapiens
  Payload ID: 4437
  Gene Symbol: CYP2J2
  Gene Name: cytochrome P450, family 2, subfamily J, polypeptide 2
  Uniprot ID: P51589
  ENSP ID: ENSP00000360247
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 21988 - protein, 501 aa, Homo sapiens
  Payload ID: 4438
  Gene Symbol: CYP2R1
  Gene Name: cytochrome P450, family 2, subfamily R, polypeptide 1
  Uniprot ID: Q6VVX0
  ENSP ID: ENSP00000334592
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 21989 - protein, 37 aa, Homo sapiens
  Payload ID: 4438
  Gene Symbol: CYP2R1
  Gene Name: cytochrome P450, family 2, subfamily R, polypeptide 1
  ENSP ID: ENSP00000432087
MPCSSKRNFCRQTMPSFIHEDDKNGRLTQFQIWPRMG

SEQ ID NO: 21990 - protein, 268 aa, Homo sapiens
  Payload ID: 4438
  Gene Symbol: CYP2R1
  Gene Name: cytochrome P450, family 2, subfamily R, polypeptide 1
  ENSP ID: ENSP00000435484
MPCSSKRNFCRQTMPSFIHEDDKNGRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 21991 - protein, 37 aa, Homo sapiens; identical to SEQ ID NO: 21989
  Payload ID: 4438
  Gene Symbol: CYP2R1
  Gene Name: cytochrome P450, family 2, subfamily R, polypeptide 1
  ENSP ID: ENSP00000465097

SEQ ID NO: 21992 - protein, 37 aa, Homo sapiens; identical to SEQ ID NO: 21989
  Payload ID: 4438
  Gene Symbol: CYP2R1
  Gene Name: cytochrome P450, family 2, subfamily R, polypeptide 1
  ENSP ID: ENSP00000466060

SEQ ID NO: 21993 - protein, 32 aa, Homo sapiens
  Payload ID: 4438
  Gene Symbol: CYP2R1
  Gene Name: cytochrome P450, family 2, subfamily R, polypeptide 1
  ENSP ID: ENSP00000466604
  MOD_RES (1)..(1): Any amino acid
XQSEIFADRPCLPLFMKMTKMGVLERPRSVPS

SEQ ID NO: 21994 - protein, 504 aa, Homo sapiens
  Payload ID: 4439
  Gene Symbol: CYP2S1
  Gene Name: cytochrome P450, family 2, subfamily S, polypeptide 1
  Uniprot ID: Q96SQ9
  ENSP ID: ENSP00000308032
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 21995 - protein, 60 aa, Homo sapiens
  Payload ID: 4439
  Gene Symbol: CYP2S1
  Gene Name: cytochrome P450, family 2, subfamily S, polypeptide 1
  ENSP ID: ENSP00000469593
MLEGTFDGHGGTKPRHRIHQQEHADDSHLFAVCWDDDGQHHGRLYPPAPDEIPSCPKVGT

SEQ ID NO: 21996 - protein, 73 aa, Homo sapiens
  Payload ID: 4439
  Gene Symbol: CYP2S1
  Gene Name: cytochrome P450, family 2, subfamily S, polypeptide 1
  ENSP ID: ENSP00000469850
AVCWDDDGQHHGRLYPPAPDEIPSCPKARRSSPSLAPSCMTPTSSSTQKSSTQTVSWMQMDGSGSMRRSCPSP

SEQ ID NO: 21997 - protein, 187 aa, Homo sapiens
  Payload ID: 4439
  Gene Symbol: CYP2S1
  Gene Name: cytochrome P450, family 2, subfamily S, polypeptide 1
  ENSP ID: ENSP00000471016
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGGTKPRHRIHQQEHADDSHLFAV

SEQ ID NO: 21998 - protein, 175 aa, Homo sapiens
  Payload ID: 4439
  Gene Symbol: CYP2S1
  Gene Name: cytochrome P450, family 2, subfamily S, polypeptide 1
  ENSP ID: ENSP00000471637
MEATGTWALLLALALLLLLTLALSGTRARGHLPPGPTPLPLLGNLLQLRPGALYSGLMREEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFP

SEQ ID NO: 21999 - protein, 165 aa, Homo sapiens
  Payload ID: 4439
  Gene Symbol: CYP2S1
  Gene Name: cytochrome P450, family 2, subfamily S, polypeptide 1
  ENSP ID: ENSP00000472555
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGGTKPRHRIHQQEHADDSHLFAVCWDDDGQHHGRLYPPAPDEIPSCPKVGT

SEQ ID NO: 22000 - protein, 544 aa, Homo sapiens
  Payload ID: 4440
  Gene Symbol: CYP2U1
  Gene Name: cytochrome P450, family 2, subfamily U, polypeptide 1
  Uniprot ID: Q7Z449
  ENSP ID: ENSP00000333212
MSSPGPSQPPAEDPPWPARLLRAPLGLLRLDPSGGALLLCGLVALLGWSWLRRRRARGIPPGPTPWPLVGNFGHVLLPPFLRRRSWLSSRTRAAGIDPSVIGPQVLLAHLARVYGSIFSFFIGHYLVVVLSDFHSVREALVQQAEVFSDRPRVPLISIVTKEKGVVFAHYGPVWRQQRKFSHSTLRHFGLGKLSLEPKIIEEFKYVKAEMQKHGEDPFCPFSIISNAVSNIICSLCFGQRFDYTNSEFKKMLGFMSRGLEICLNSQVLLVNICPWLYYLPFGPFKELRQIEKDITSFLKKIIKDHQESLDRENPQDFIDMYLLHMEEERKNNSNSSFDEEYLFYIIGDLFIAGTDTTTNSLLWCLLYMSLNPDVQEKVHEEIERVIGANRAPSLTDKAQMPYTEATIMEVQRLTVVVPLAIPHMTSENTVLQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 22001 - protein, 335 aa, Homo sapiens
  Payload ID: 4440
  Gene Symbol: CYP2U1
  Gene Name: cytochrome P450, family 2, subfamily U, polypeptide 1
  ENSP ID: ENSP00000423667
MQKHGEDPFCPFSIISNAVSNIICSLCFGQRFDYTNSEFKKMLGFMSRGLEICLNSQVLLVNICPWLYYLPFGPFKELRQIEKDITSFLKKIIKDHQESLDRENPQDFIDMYLLHMEEERKNNSNSSFDEEYLFYIIGDLFIAGTDTTTNSLLWCLLYMSLNPDVQEKVHEEIERVIGANRAPSLTDKAQMPYTEATIMEVQRLTVVVPLAIPHMTSENTVLQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 22002 - protein, 490 aa, Homo sapiens
  Payload ID: 4441
  Gene Symbol: CYP2W1
  Gene Name: cytochrome P450, family 2, subfamily W, polypeptide 1
  Uniprot ID: Q8TAV3
  ENSP ID: ENSP00000310149
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGRRVCVGERLARTELFLLFAGLLQRYRLLPPPGVSPASLDTTPARAFTMRPRAQALCAVPRP

SEQ ID NO: 22003 - protein, 408 aa, Homo sapiens
  Payload ID: 4441
  Gene Symbol: CYP2W1
  Gene Name: cytochrome P450, family 2, subfamily W, polypeptide 1
  ENSP ID: ENSP00000344178
MELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGQQPSGPGWGGTSRAPGVGRPQLRLPPLHPPPDLRF

SEQ ID NO: 22004 - protein, 288 aa, Homo sapiens
  Payload ID: 4441
  Gene Symbol: CYP2W1
  Gene Name: cytochrome P450, family 2, subfamily W, polypeptide 1
  ENSP ID: ENSP00000392581
LQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGSEGGCGGCSCAPLGRSPPLPSRSRPGAAHSVPGHPPQAAASVLGSAWPGPSSSCCLPASCRGTACCPRLASVRPPWTPRPPGLLP

SEQ ID NO: 22005 - protein, 462 aa, Homo sapiens
  Payload ID: 4442
  Gene Symbol: CYP20A1
  Gene Name: cytochrome P450, family 20, subfamily A, polypeptide 1
  Uniprot ID: Q6UW02
  ENSP ID: ENSP00000348380
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 22006 - protein, 44 aa, Homo sapiens
  Payload ID: 4442
  Gene Symbol: CYP20A1
  Gene Name: cytochrome P450, family 20, subfamily A, polypeptide 1
  ENSP ID: ENSP00000388070
MLDFAIFAVTFLLALVGAVLYLYPASRQAAGIPGITPTEENGPF

SEQ ID NO: 22007 - protein, 44 aa, Homo sapiens; identical to SEQ ID NO: 22006
  Payload ID: 4442
  Gene Symbol: CYP20A1
  Gene Name: cytochrome P450, family 20, subfamily A, polypeptide 1
  ENSP ID: ENSP00000398046

SEQ ID NO: 22008 - protein, 470 aa, Homo sapiens
  Payload ID: 4442
  Gene Symbol: CYP20A1
  Gene Name: cytochrome P450, family 20, subfamily A, polypeptide 1
  ENSP ID: ENSP00000407860
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTLCIFTYFQVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 22009 - protein, 258 aa, Homo sapiens
  Payload ID: 4442
  Gene Symbol: CYP20A1
  Gene Name: cytochrome P450, family 20, subfamily A, polypeptide 1
  ENSP ID: ENSP00000411341
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTILEDSMIFSLASCIITAKLCTWAICFLTTSEEVQKKLYEEINQVFGNGPVTPEKIEQL

SEQ ID NO: 22010 - protein, 208 aa, Homo sapiens
  Payload ID: 4442
  Gene Symbol: CYP20A1
  Gene Name: cytochrome P450, family 20, subfamily A, polypeptide 1
  ENSP ID: ENSP00000414831
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTPSCNWSLF

SEQ ID NO: 22011 - protein, 435 aa, Homo sapiens
  Payload ID: 4442
  Gene Symbol: CYP20A1
  Gene Name: cytochrome P450, family 20, subfamily A, polypeptide 1
  Uniprot ID: Q6UW02
  ENSP ID: ENSP00000477866
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTPSCNWSLFKEHHKRTKRKELQSTYFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 22012 - protein, 192 aa, Homo sapiens
  Payload ID: 4442
  Gene Symbol: CYP20A1
  Gene Name: cytochrome P450, family 20, subfamily A, polypeptide 1
  ENSP ID: ENSP00000482757
MIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 22013 - protein, 465 aa, Homo sapiens
  Payload ID: 4443
  Gene Symbol: CYP21A2
  Gene Name: cytochrome P450, family 21, subfamily A, polypeptide 2
  Uniprot ID: P08686
  ENSP ID: ENSP00000372811
MLLLGLLLLLPLLAGARLLWNWWKLRSLHLPPLAPGFLHLLQPDLPIYLLGLTQKFGPIYRLHLGLQDKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 22014 - protein, 495 aa, Homo sapiens
  Payload ID: 4443
  Gene Symbol: CYP21A2
  Gene Name: cytochrome P450, family 21, subfamily A, polypeptide 2
  ENSP ID: ENSP00000372812
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 22015 - protein, 464 aa, Homo sapiens
  Payload ID: 4443
  Gene Symbol: CYP21A2
  Gene Name: cytochrome P450, family 21, subfamily A, polypeptide 2
  ENSP ID: ENSP00000390312
MLLLGLLLLPLLAGARLLWNWWKLRSLHLPPLAPGFLHLLQPDLPIYLLGLTQKFGPIYRLHLGLQDKLVSKNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQNQ

SEQ ID NO: 22016 - protein, 465 aa, Homo sapiens; identical to SEQ ID NO: 22013
  Payload ID: 4443
  Gene Symbol: CYP21A2
  Gene Name: cytochrome P450, family 21, subfamily A, polypeptide 2
  Uniprot ID: P08686
  ENSP ID: ENSP00000392321

SEQ ID NO: 22017 - protein, 495 aa, Homo sapiens; identical to SEQ ID NO: 22014
  Payload ID: 4443
  Gene Symbol: CYP21A2
  Gene Name: cytochrome P450, family 21, subfamily A, polypeptide 2
  ENSP ID: ENSP00000394942

SEQ ID NO: 22018 - protein, 494 aa, Homo sapiens [sequence omitted]

SEQ ID NO: 22019 - protein, 465 aa, Homo sapiens; identical to SEQ ID NO: 22013
  Payload ID: 4443
  Gene Symbol: CYP21A2
  Gene Name: cytochrome P450, family 21, subfamily A, polypeptide 2
  Uniprot ID: P08686
  ENSP ID: ENSP00000403230

SEQ ID NO: 22020 - protein, 494 aa, Homo sapiens [sequence omitted]

SEQ ID NO: 22021 - protein, 464 aa, Homo sapiens; identical to SEQ ID NO: 22015
  Payload ID: 4443
  Gene Symbol: CYP21A2
  Gene Name: cytochrome P450, family 21, subfamily A, polypeptide 2
  ENSP ID: ENSP00000407338

SEQ ID NO: 22022 - protein, 495 aa, Homo sapiens; identical to SEQ ID NO: 22014
  Payload ID: 4443
  Gene Symbol: CYP21A2
  Gene Name: cytochrome P450, family 21, subfamily A, polypeptide 2
  ENSP ID: ENSP00000408860

SEQ ID NO: 22023 - protein, 465 aa, Homo sapiens; identical to SEQ ID NO: 22013
  Payload ID: 4443
  Gene Symbol: CYP21A2
  Gene Name: cytochrome P450, family 21, subfamily A, polypeptide 2
  Uniprot ID: P08686
  ENSP ID: ENSP00000415043

SEQ ID NO: 22024 - protein, 495 aa, Homo sapiens; identical to SEQ ID NO: 22014
  Payload ID: 4443
  Gene Symbol: CYP21A2
  Gene Name: cytochrome P450, family 21, subfamily A, polypeptide 2
  ENSP ID: ENSP00000416598

SEQ ID NO: 22025 - protein, 108 aa, Homo sapiens
  Payload ID: 4443
  Gene Symbol: CYP21A2
  Gene Name: cytochrome P450, family 21, subfamily A, polypeptide 2
  ENSP ID: ENSP00000417321
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTSPTSSCRQAGV

SEQ ID NO: 22026 - protein, 78 aa, Homo sapiens
  Payload ID: 4443
  Gene Symbol: CYP21A2
  Gene Name: cytochrome P450, family 21, subfamily A, polypeptide 2
  ENSP ID: ENSP00000418104
MLLLGLLLLLPLLAGARLLWNWWKLRSLHLPPLAPGFLHLLQPDLPIYLLGLTQKFGPIYRLHLGLQAPTSSCRQAGV

SEQ ID NO: 22027 - protein, 190 aa, Homo sapiens
  Payload ID: 4443
  Gene Symbol: CYP21A2
  Gene Name: cytochrome P450, family 21, subfamily A, polypeptide 2
  ENSP ID: ENSP00000418561
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKEVLKTWS

SEQ ID NO: 22028 - protein, 186 aa, Homo sapiens
  Payload ID: 4443
  Gene Symbol: CYP21A2
  Gene Name: cytochrome P450, family 21, subfamily A, polypeptide 2
  ENSP ID: ENSP00000419572
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTFPTLQPPPPPADKLVSRNYPDLSLGDYSLLWKAHKKLTRSALLLGIRDSMEPVVEQLTQEFCERMRAQPGTPVAIEEEFSLLTCSIICY

SEQ ID NO: 22029 - protein, 514 aa, Homo sapiens
  Payload ID: 4444
  Gene Symbol: CYP24A1
  Gene Name: cytochrome P450, family 24, subfamily A, polypeptide 1
  Uniprot ID: Q07973
  ENSP ID: ENSP00000216862
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 22030 - protein, 372 aa, Homo sapiens
  Payload ID: 4444
  Gene Symbol: CYP24A1
  Gene Name: cytochrome P450, family 24, subfamily A, polypeptide 1
  Uniprot ID: Q07973
  ENSP ID: ENSP00000379284
MYSCFSHREGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 22031 - protein, 448 aa, Homo sapiens
  Payload ID: 4444
  Gene Symbol: CYP24A1
  Gene Name: cytochrome P450, family 24, subfamily A, polypeptide 1
  Uniprot ID: Q07973
  ENSP ID: ENSP00000379285
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGIVRKYDIQATDNEPVEMLHSGTLVPSRELPIAFCQR

SEQ ID NO: 22032 - protein, 497 aa, Homo sapiens
  Payload ID: 4445
  Gene Symbol: CYP26A1
  Gene Name: cytochrome P450, family 26, subfamily A, polypeptide 1
  Uniprot ID: O43174
  ENSP ID: ENSP00000224356
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 22033 - protein, 428 aa, Homo sapiens
  Payload ID: 4445
  Gene Symbol: CYP26A1
  Gene Name: cytochrome P450, family 26, subfamily A, polypeptide 1
  Uniprot ID: O43174
  ENSP ID: ENSP00000360586
MKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 22034 - protein, 256 aa, Homo sapiens
  Payload ID: 4445
  Gene Symbol: CYP26A1
  Gene Name: cytochrome P450, family 26, subfamily A, polypeptide 1
  ENSP ID: ENSP00000485126
MKRRKYGFIYKTHLFGRPTVRVMGADNVRRILLGEHRLVSVHWPASVRTILGSGCLSNLHDSSHKQRKKPRGTRMLRAGDHRGSGQQPGAVAELRRARPPGLPRGEAPHVPNRHAHPTGLRTPTGGRRGLRAAACGGLRGNDPQSLLAAHRRALQRAVPGHEGAEPHSRAHRAEHSRQDLRAAGIRGGPGLQRRAAAVDRALVGEGRAAGHAGTKAIFNRTPLWRTRNHGQCSHISDHLPGALPTCSPESARRAEE

SEQ ID NO: 22035 - protein, 512 aa, Homo sapiens
  Payload ID: 4446
  Gene Symbol: CYP26B1
  Gene Name: cytochrome P450, family 26, subfamily B, polypeptide 1
  Uniprot ID: Q9NR63
  ENSP ID: ENSP00000001146
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 22036 - protein, 321 aa, Homo sapiens
  Payload ID: 4446
  Gene Symbol: CYP26B1
  Gene Name: cytochrome P450, family 26, subfamily B, polypeptide 1
  ENSP ID: ENSP00000401465
MAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 22037 - protein, 172 aa, Homo sapiens
  Payload ID: 4446
  Gene Symbol: CYP26B1
  Gene Name: cytochrome P450, family 26, subfamily B, polypeptide 1
  ENSP ID: ENSP00000430871
MKNKTCVLVCVSVFGGERGQVTVPRVGVRRPSLAGPLQKCTLRETRVWLPQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLT

SEQ ID NO: 22038 - protein, 182 aa, Homo sapiens
  Payload ID: 4446
  Gene Symbol: CYP26B1
  Gene Name: cytochrome P450, family 26, subfamily B, polypeptide 1
  ENSP ID: ENSP00000430888
MLFEGLDLVSALATLAACLVSVTLLLAVSQQLWQLRWAATRDKSCKLPIPKGSMGFPLIGETGHWLLQVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQC

SEQ ID NO: 22039 - protein, 437 aa, Homo sapiens
  Payload ID: 4446
  Gene Symbol: CYP26B1
  Gene Name: cytochrome P450, family 26, subfamily B, polypeptide 1
  Uniprot ID: Q9NR63
  ENSP ID: ENSP00000443304
MLFEGLDLVSALATLAACLVSVTLLLAVSQQLWQLRWAATRDKSCKLPIPKGSMGFPLIGETGHWLLQVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 22040 - protein, 522 aa, Homo sapiens
  Payload ID: 4447
  Gene Symbol: CYP26C1
  Gene Name: cytochrome P450, family 26, subfamily C, polypeptide 1
  Uniprot ID: Q6V0L0
  ENSP ID: ENSP00000285949
MFPWGLSCLSVLGAAGTALLCAGLLLSLAQHLWTLRWMLSRDRASTLPLPKGSMGWPFFGETLHWLVQGSRFHSSRRERYGTVFKTHLLGRPVIRVSGAENVRTILLGEHRLVRSQWPQSAHILLGSHTLLGAVGEPHRRRRKVLARVFSRAALERYVPRLQGALRHEVRSWCAAGGPVSVYDASKALTFRMAARILLGLRLDEAQCATLARTFEQLVENLFSLPLDVPFSGLRKGIRARDQLHRHLEGAISEKLHEDKAAEPGDALDLIIHSARELGHEPSMQELKESAVELLFAAFFTTASASTSLVLLLLQHPAAIAKIREELVAQGLGRACGCAPGAAGGSEGPPPDCGCEPDLSLAALGRLRYVDCVVKEVLRLLPPVSGGYRTALRTFELDGYQIPKGWSVMYSIRDTHETAAVYRSPPEGFDPERFGAAREDSRGASSRFHYIPFGGGARSCLGQELAQAVLQLLAVELVRTARWELATPAFPAMQTVPIVHPVDGLRLFFHPLTPSVAGNGLCL

SEQ ID NO: 22041 - protein, 302 aa, Homo sapiens
  Payload ID: 4447
  Gene Symbol: CYP26C1
  Gene Name: cytochrome P450, family 26, subfamily C, polypeptide 1
  ENSP ID: ENSP00000485098
MFPWGLSCLSVLGAAGTALLCAGLLLSLAQHLWTLRWMLSRDRASTLPLPKGSMGWPFFGETLHWLVQGSRFHSSRRERYGTVFKTHLLGRPVIRVSGAENVRTILLGEHRLVRSQWPQSAHILLGSHTLLGAVGEPHRRRRKVLARVFSRAALERYVPRLQGALRHEVRSWCAAGGPVSVYDASKALTFRMAARILLGLRLDEAQCATLARTFEQLVENLFSLPLDVPFSGLRKVRPPRLQTFLRGSAARAGLPDPDGTPSAHPARPSPLLGTAAGPGGGRRCGGGVAVGSGPGLCAGSLV

SEQ ID NO: 22042 - protein, 531 aa, Homo sapiens
  Payload ID: 4448
  Gene Symbol: CYP27A1
  Gene Name: cytochrome P450, family 27, subfamily A, polypeptide 1
  Uniprot ID: Q02318
  ENSP ID: ENSP00000258415
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 22043 - protein, 221 aa, Homo sapiens
  Payload ID: 4448
  Gene Symbol: CYP27A1
  Gene Name: cytochrome P450, family 27, subfamily A, polypeptide 1
  ENSP ID: ENSP00000392671
MWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLL

SEQ ID NO: 22044 - protein, 115 aa, Homo sapiens
  Payload ID: 4448
  Gene Symbol: CYP27A1
  Gene Name: cytochrome P450, family 27, subfamily A, polypeptide 1
  ENSP ID: ENSP00000404945
MAALGCARLRWALRGAGRGLCPHGARAKAAIPAALPSDKATGAPGAGPGVRRRQRSLEEIPRLGQLRFFFQLFVQGYALQLHQLQGRTPLVPAAPGSEPAVAEASGSSALYGCFQ

SEQ ID NO: 22045 - protein, 508 aa, Homo sapiens
  Payload ID: 4449
  Gene Symbol: CYP27B1
  Gene Name: cytochrome P450, family 27, subfamily B, polypeptide 1
  Uniprot ID: O15528
  ENSP ID: ENSP00000228606
MTQTLKYASRVFHRVRWAPELGASLGYREYHSARRSLADIPGPSTPSFLAELFCKGGLSRLHELQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 22046 - protein, 157 aa, Homo sapiens
  Payload ID: 4449
  Gene Symbol: CYP27B1
  Gene Name: cytochrome P450, family 27, subfamily B, polypeptide 1
  ENSP ID: ENSP00000449472
MAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPD

SEQ ID NO: 22047 - protein, 234 aa, Homo sapiens
  Payload ID: 4449
  Gene Symbol: CYP27B1
  Gene Name: cytochrome P450, family 27, subfamily B, polypeptide 1
  ENSP ID: ENSP00000476959
  MOD_RES (1)..(1): Any amino acid
XTLAGPRLPGIREKSRSPGSSQLRLLELRHSTLLKKVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAF

SEQ ID NO: 22048 - protein, 372 aa, Homo sapiens
  Payload ID: 4450
  Gene Symbol: CYP27C1
  Gene Name: cytochrome P450, family 27, subfamily C, polypeptide 1
  Uniprot ID: Q4G0S4
  ENSP ID: ENSP00000334128
MRSVLRQRILKPKDVAIYSGEVNQVIADLIKRIYLLRSQAEDGETVTNVNDLFFKYSMEGVATILYESRLGCLENSIPQLTVEYIEALELMFSMFKTSMYAGAIPRWLRPFIPKPWREFCRSWDGLFKFSQIHVDNKLRDIQYQMDRGRRVSGGLLTYLFLSQALTLQEIYANVTEMLLAGVDTTSFTLSWTVYLLARHPEVQQTVYREIVKNLGERHVPTAADVPKVPLVRALLKETLRLFPVLPGNGRVTQEDLVIGGYLIPKGTQLALCHYATSYQDENFPRAKEFRPERWLRKGDLDRVDNFGSIPFGHGVRSCIGRRIAELEIHLVVIQLLQHFEIKTSSQTNAVHAKTHGLLTPGGPIHVRFVNRK

SEQ ID NO: 22049 - protein, 372 aa, Homo sapiens; identical to SEQ ID NO: 22048
  Payload ID: 4450
  Gene Symbol: CYP27C1
  Gene Name: cytochrome P450, family 27, subfamily C, polypeptide 1
  Uniprot ID: Q4G0S4
  ENSP ID: ENSP00000387198

SEQ ID NO: 22050 - protein, 503 aa, Homo sapiens
  Payload ID: 4451
  Gene Symbol: CYP3A4
  Gene Name: cytochrome P450, family 3, subfamily A, polypeptide 4
  Uniprot ID: P08684
  ENSP ID: ENSP00000337915
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 22051 - protein, 353 aa, Homo sapiens
  Payload ID: 4451
  Gene Symbol: CYP3A4
  Gene Name: cytochrome P450, family 3, subfamily A, polypeptide 4
  ENSP ID: ENSP00000346607
MALIPDLAMETWLLLAVSLVLLYLVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 22052 - protein, 153 aa, Homo sapiens
  Payload ID: 4451
  Gene Symbol: CYP3A4
  Gene Name: cytochrome P450, family 3, subfamily A, polypeptide 4
  ENSP ID: ENSP00000397208
MALIPDLAMETWLLLAVSLVLLYLHNRCDLISVSLCRYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSG

SEQ ID NO: 22053 - protein, 504 aa, Homo sapiens
  Payload ID: 4452
  Gene Symbol: CYP3A43
  Gene Name: cytochrome P450, family 3, subfamily A, polypeptide 43
  Uniprot ID: Q9HB55
  ENSP ID: ENSP00000222382
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPESRFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 22054 - protein, 420 aa, Homo sapiens
  Payload ID: 4452
  Gene Symbol: CYP3A43
  Gene Name: cytochrome P450, family 3, subfamily A, polypeptide 43
  Uniprot ID: Q9HB55
  ENSP ID: ENSP00000312110
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERSH

SEQ ID NO: 22055 - protein, 126 aa, Homo sapiens
  Payload ID: 4452
  Gene Symbol: CYP3A43
  Gene Name: cytochrome P450, family 3, subfamily A, polypeptide 43
  ENSP ID: ENSP00000345351
MDLIPNFAMETWVLVATSLVLLYIYGTHSHKLFKKLGIPGPTPLPFLGTILFYLRGLWNFDRECNEKFLWGLHHGCNHWHIIWSELGFSQQSTRSLSEKYEEAFKIGFFGSLFTLNITLSISYPSF

SEQ ID NO: 22056 - protein, 503 aa, Homo sapiens
  Payload ID: 4452
  Gene Symbol: CYP3A43
  Gene Name: cytochrome P450, family 3, subfamily A, polypeptide 43
  Uniprot ID: Q9HB55
  ENSP ID: ENSP00000346887
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 22057 - protein, 96 aa, Homo sapiens
  Payload ID: 4452
  Gene Symbol: CYP3A43
  Gene Name: cytochrome P450, family 3, subfamily A, polypeptide 43
  ENSP ID: ENSP00000400316
MDLIPNFAMETWVLVATSLVLLYIYGTHSHKLFKKLGIPGPTPLPFLGTILFYLRPLGPMGFLKSALSFAEDEEWKRIRTLLSPAFTSVKFKEVRK

SEQ ID NO: 22058 - protein, 292 aa, Homo sapiens
  Payload ID: 4452
  Gene Symbol: CYP3A43
  Gene Name: cytochrome P450, family 3, subfamily A, polypeptide 43
  ENSP ID: ENSP00000401521
MDLIPNFAMETWVLVATSLVLLYIYGTHSHKLFKKLGIPGPTPLPFLGTILFYLRHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 22059 - protein, 167 aa, Homo sapiens
  Payload ID: 4452
  Gene Symbol: CYP3A43
  Gene Name: cytochrome P450, family 3, subfamily A, polypeptide 43
  ENSP ID: ENSP00000405557
MGSCGYQPGTPLYHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERSH

SEQ ID NO: 22060 - protein, 250 aa, Homo sapiens
  Payload ID: 4452
  Gene Symbol: CYP3A43
  Gene Name: cytochrome P450, family 3, subfamily A, polypeptide 43
  Uniprot ID: Q9HB55
  ENSP ID: ENSP00000411653
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLIYRVSLCCLGRSAWCDLGSLKPPPPGFE

SEQ ID NO: 22061 - protein, 56 aa, Homo sapiens
  Payload ID: 4452
  Gene Symbol: CYP3A43
  Gene Name: cytochrome P450, family 3, subfamily A, polypeptide 43
  ENSP ID: ENSP00000415221
MDLIPNFAMETWVLVATSLVLLYMVFGILTENVMKNTEKCGAFRSNGISEKCLKFC

SEQ ID NO: 22062 - protein, 393 aa, Homo sapiens
  Payload ID: 4452
  Gene Symbol: CYP3A43
  Gene Name: cytochrome P450, family 3, subfamily A, polypeptide 43
  Uniprot ID: Q9HB55
  ENSP ID: ENSP00000416581
MDLIPNFAMETWVLVATSLVLLYIYGTHSHKLFKKLGIPGPTPLPFLGTILFYLRRSLNKIPSWAWWLTPVIPALWEAEAGGSPKVRSSRPALPTWVFGILTENVMKNTEKCGALFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 22063 - protein, 74 aa, Homo sapiens
  Payload ID: 4452
  Gene Symbol: CYP3A43
  Gene Name: cytochrome P450, family 3, subfamily A, polypeptide 43
  ENSP ID: ENSP00000486759
MDLIPNFAMETWVLVATSLVLLYIYGTHSHKLFKKLGIPGPTPLPFLGTILFYLRGLWNFDRECNEKYGEMWGP

SEQ ID NO: 22064 - protein, 502 aa, Homo sapiens
  Payload ID: 4453
  Gene Symbol: CYP3A5
  Gene Name: cytochrome P450, family 3, subfamily A, polypeptide 5
  Uniprot ID: P20815
  ENSP ID: ENSP00000222982
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 22065 - protein, 39 aa, Homo sapiens
  Payload ID: 4453
  Gene Symbol: CYP3A5
  Gene Name: cytochrome P450, family 3, subfamily A, polypeptide 5
  ENSP ID: ENSP00000343074
MDLIPNLAVETWLLLAVSLVLLYLMRVPKSAKSPLTKQT

SEQ ID NO: 22066 - protein, 140 aa, Homo sapiens
  Payload ID: 4453
  Gene Symbol: CYP3A5
  Gene Name: cytochrome P450, family 3, subfamily A, polypeptide 5
  Uniprot ID: P20815
  ENSP ID: ENSP00000401269
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRICATTSTIKMQTHSVTMWLPPAVLQSQHGVCLFL

SEQ ID NO: 22067 - protein, 39 aa, Homo sapiens; identical to SEQ ID NO: 22065
  Payload ID: 4453
  Gene Symbol: CYP3A5
  Gene Name: cytochrome P450, family 3, subfamily A, polypeptide 5
  ENSP ID: ENSP00000415399

SEQ ID NO: 22068 - protein, 503 aa, Homo sapiens
  Payload ID: 4454
  Gene Symbol: CYP3A7
  Gene Name: cytochrome P450, family 3, subfamily A, polypeptide 7
  Uniprot ID: P24462
  ENSP ID: ENSP00000337450
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 22069 - protein, 469 aa, Homo sapiens
  Payload ID: 4455
  Gene Symbol: CYP39A1
  Gene Name: cytochrome P450, family 39, subfamily A, polypeptide 1
  Uniprot ID: Q9NYL5
  ENSP ID: ENSP00000275016
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMTLLQATLDIVETETSKENSPNYGLLLLWASLSNAVPVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 22070 - protein, 297 aa, Homo sapiens
  Payload ID: 4455
  Gene Symbol: CYP39A1
  Gene Name: cytochrome P450, family 39, subfamily A, polypeptide 1
  ENSP ID: ENSP00000477769
MLFNKSLFSTNKKKIKEFHQYFQVYDEDFEYGSQLPECLLRNWSKSKKWFLELFEKNIPDIKACKSAKDNSMTLLQATLDIVETETSKENSPNYGLLLLWASLSNAVPVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 22071 - protein, 519 aa, Homo sapiens
  Payload ID: 4456
  Gene Symbol: CYP4A11
  Gene Name: cytochrome P450, family 4, subfamily A, polypeptide 11
  Uniprot ID: Q02928
  ENSP ID: ENSP00000311095
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 22072 - protein, 520 aa, Homo sapiens [sequence omitted]

SEQ ID NO: 22073 - protein, 455 aa, Homo sapiens
  Payload ID: 4456
  Gene Symbol: CYP4A11
  Gene Name: cytochrome P450, family 4, subfamily A, polypeptide 11
  ENSP ID: ENSP00000360972
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSR

SEQ ID NO: 22074 - protein, 215 aa, Homo sapiens
  Payload ID: 4456
  Gene Symbol: CYP4A11
  Gene Name: cytochrome P450, family 4, subfamily A, polypeptide 11
  ENSP ID: ENSP00000476368
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFRHWQRAQHSRHLP

SEQ ID NO: 22075 - protein, 377 aa, Homo sapiens
  Payload ID: 4456
  Gene Symbol: CYP4A11
  Gene Name: cytochrome P450, family 4, subfamily A, polypeptide 11
  ENSP ID: ENSP00000476619
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGV

SEQ ID NO: 22076 - protein, 264 aa, Homo sapiens
  Payload ID: 4456
  Gene Symbol: CYP4A11
  Gene Name: cytochrome P450, family 4, subfamily A, polypeptide 11
  ENSP ID: ENSP00000476854
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRPSDPTEEGSTTEGGGAGEDQEEEAFGFSGYPPLGQRTTWTRCPTPPCALRRH

SEQ ID NO: 22077 - protein, 249 aa, Homo sapiens
  Payload ID: 4456
  Gene Symbol: CYP4A11
  Gene Name: cytochrome P450, family 4, subfamily A, polypeptide 11
  ENSP ID: ENSP00000476988
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRPSDPTEEGSTTEGGGAGEDQEEEAFGFSGYPPLGQSV

SEQ ID NO: 22078 - protein, 421 aa, Homo sapiens
  Payload ID: 4456
  Gene Symbol: CYP4A11
  Gene Name: cytochrome P450, family 4, subfamily A, polypeptide 11
  ENSP ID: ENSP00000477495
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRPSDPTEEGSTTEGGGAGEDQEEEAFGFSGYPPLGQRAPGLPRPCWCSGWNCFRNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 22079 - protein, 455 aa, Homo sapiens
  Payload ID: 4457
  Gene Symbol: CYP4A22
  Gene Name: cytochrome P450, family 4, subfamily A, polypeptide 22
  ENSP ID: ENSP00000294337
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRNSQSYIQAISDLNSLVFCCMRNAFHENDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHGLLGDGASITWNHLDQMPYTTMCIKEALRLYPPVPGIGRELSTPVTFPDGRSLPKGIMVLLSIYGLHHNPKVWPNLEVFDPSRFAPGSAQHSHAFLPFSGGSR

SEQ ID NO: 22080 - protein, 421 aa, Homo sapiens
  Payload ID: 4457
  Gene Symbol: CYP4A22
  Gene Name: cytochrome P450, family 4, subfamily A, polypeptide 22
  ENSP ID: ENSP00000360957
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRPSDPTEEGSTTEGGGAGEDQEEEALGFSGHPPLGQRAPGLPRPCWCSGWNCFRNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 22081 - protein, 519 aa, Homo sapiens
  Payload ID: 4457
  Gene Symbol: CYP4A22
  Gene Name: cytochrome P450, family 4, subfamily A, polypeptide 22
  Uniprot ID: Q5TCH4
  ENSP ID: ENSP00000360958
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRNSQSYIQAISDLNSLVFCCMRNAFHENDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHGLLGDGASITWNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 22082 - protein, 520 aa, Homo sapiens
  Payload ID: 4457
  Gene Symbol: CYP4A22
  Gene Name: cytochrome P450, family 4, subfamily A, polypeptide 22
  ENSP ID: ENSP00000479019
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRNSQSYIQAISDLNSLVFCCMRNAFHENDTIYSLTSAGRWTHRACQLAHQHTGDQVIQLRKAQLQKEGELEKIKRKRHLDFLDILLLAKMENGSILSDKDLRAEVDTFMFEGHDTTASGISWILYALATHPKHQERCREEIHGLLGDGASITWNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 22083 - protein, 357 aa, Homo sapiens
  Payload ID: 4457
  Gene Symbol: CYP4A22
  Gene Name: cytochrome P450, family 4, subfamily A, polypeptide 22
  ENSP ID: ENSP00000482952
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRPSDPTEEGSTTEGGGAGEDQEEEALGFSGHPPLGQRAPGLPRPCWCSGWNCFRNHLDQMPYTTMCIKEALRLYPPVPGIGRELSTPVTFPDGRSLPKGIMVLLSIYGLHHNPKVWPNLEVFDPSRFAPGSAQHSHAFLPFSGGSR

SEQ ID NO: 22084 - protein, 511 aa, Homo sapiens
  Payload ID: 4458
  Gene Symbol: CYP4B1
  Gene Name: cytochrome P450, family 4, subfamily B, polypeptide 1
  Uniprot ID: P13584
  ENSP ID: ENSP00000271153
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 22085 - protein, 497 aa, Homo sapiens
  Payload ID: 4458
  Gene Symbol: CYP4B1
  Gene Name: cytochrome P450, family 4, subfamily B, polypeptide 1
  ENSP ID: ENSP00000360987
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGGRGLLVLEGPKWLQHRKLLTPGFHYDVLKPYVAVFTESTRIMLDKWEEKAREGKSFDIFCDVGHMALNTLMKCTFGRGDTGLGHSRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 22086 - protein, 512 aa, Homo sapiens
  Payload ID: 4458
  Gene Symbol: CYP4B1
  Gene Name: cytochrome P450, family 4, subfamily B, polypeptide 1
  Uniprot ID: P13584
  ENSP ID: ENSP00000360991
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHSRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 22087 - protein, 325 aa, Homo sapiens
  Payload ID: 4458
  Gene Symbol: CYP4B1
  Gene Name: cytochrome P450, family 4, subfamily B, polypeptide 1
  ENSP ID: ENSP00000433068
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHSTIMTSSTGSPHMAAASCGPARWPMTIQTRSSGSGRQPCRMRRCGRRSRTGGTWTSWTFSWVPGMKMTSNCQMQTSGLKWTHSCLKAMTPPPVVSPGFSTAWPCTLSTSIVVERRSARS

SEQ ID NO: 22088 - protein, 87 aa, Homo sapiens
  Payload ID: 4458
  Gene Symbol: CYP4B1
  Gene Name: cytochrome P450, family 4, subfamily B, polypeptide 1
  ENSP ID: ENSP00000433367
MVPSFLSLSFSSLGLWASGLILVLGFLKLIHLLLRRQTLAKAMDKFPGPPTHWLFGHALEGEACWFLRGPSGCSTASCSHLAFIMMC

SEQ ID NO: 22089 - protein, 70 aa, Homo sapiens
  Payload ID: 4458
  Gene Symbol: CYP4B1
  Gene Name: cytochrome P450, family 4, subfamily B, polypeptide 1
  ENSP ID: ENSP00000438995
MLDKWEEKAREGKSFDIFCDVGHMALNTLMKCTFGRGDTGLGHSRDSSYYLAVSDLTLLMQQRLVSFQYH

SEQ ID NO: 22090 - protein, 138 aa, Homo sapiens
  Payload ID: 4458
  Gene Symbol: CYP4B1
  Gene Name: cytochrome P450, family 4, subfamily B, polypeptide 1
  ENSP ID: ENSP00000443212
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGGGCVSFVSHLAMSSDTSSWTQALWVQLRYRN

SEQ ID NO: 22091 - protein, 295 aa, Homo sapiens [sequence omitted]

SEQ ID NO: 22092 - protein, 524 aa, Homo sapiens
  Payload ID: 4459
  Gene Symbol: CYP4F11
  Gene Name: cytochrome P450, family 4, subfamily F, polypeptide 11
  Uniprot ID: Q9HBI6
  ENSP ID: ENSP00000248041
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 22093 - protein, 454 aa, Homo sapiens
  Payload ID: 4459
  Gene Symbol: CYP4F11
  Gene Name: cytochrome P450, family 4, subfamily F, polypeptide 11
  ENSP ID: ENSP00000319859
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGLRPLPFRPREHQGEVTSGFYSLLGRAQKLHRAGVRHG

SEQ ID NO: 22094 - protein, 524 aa, Homo sapiens; identical to SEQ ID NO: 22092
  Payload ID: 4459
  Gene Symbol: CYP4F11
  Gene Name: cytochrome P450, family 4, subfamily F, polypeptide 11
  Uniprot ID: Q9HBI6
  ENSP ID: ENSP00000384588

SEQ ID NO: 22095 - protein, 199 aa, Homo sapiens
  Payload ID: 4459
  Gene Symbol: CYP4F11
  Gene Name: cytochrome P450, family 4, subfamily F, polypeptide 11
  ENSP ID: ENSP00000476972
MFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 22096 - protein, 454 aa, Homo sapiens; identical to SEQ ID NO: 22093
  Payload ID: 4459
  Gene Symbol: CYP4F11
  Gene Name: cytochrome P450, family 4, subfamily F, polypeptide 11
  ENSP ID: ENSP00000481243

SEQ ID NO: 22097 - protein, 524 aa, Homo sapiens
  Payload ID: 4460
  Gene Symbol: CYP4F12
  Gene Name: cytochrome P450, family 4, subfamily F, polypeptide 12
  ENSP ID: ENSP00000321821
MSLLSLPWLGLRPVATSPWLLLLLVVGSWLLARILAWTYAFYNNCRRLQCFPQPPKRNWFWGHLGLITPTEEGLKNSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVSLQ

SEQ ID NO: 22098 - protein, 102 aa, Homo sapiens
  Payload ID: 4460
  Gene Symbol: CYP4F12
  Gene Name: cytochrome P450, family 4, subfamily F, polypeptide 12
  Uniprot ID: Q9HCS2
  ENSP ID: ENSP00000430849
MSLLSLPWLGLRPVATSPWLLLLLVVGSWLLARILAWTYAFYNNCRRLQCFPQPPKRNWFWGHLGLITPTEEGLKNSTQMSATYSQGFTLPLHPRIISSSGS

SEQ ID NO: 22099 - protein, 79 aa, Homo sapiens
  Payload ID: 4460
  Gene Symbol: CYP4F12
  Gene Name: cytochrome P450, family 4, subfamily F, polypeptide 12
  ENSP ID: ENSP00000446812
MSLLSLPWLGLRPVATSPWLLLLLVVGSWLLARILAWTYAFYNNCRRLQCFPQPPKRNWFWGHLGLLPLHPRIISSSGS

SEQ ID NO: 22100 - protein, 70 aa, Homo sapiens
  Payload ID: 4460
  Gene Symbol: CYP4F12
  Gene Name: cytochrome P450, family 4, subfamily F, polypeptide 12
  ENSP ID: ENSP00000447922
MGNWGFPGNWTPSKLPRIQITPTEEGLKNSTQMSATYSQGFTVWLGPIIPFIVLCHPDTIRSITNASAAI

SEQ ID NO: 22101 - protein, 104 aa, Homo sapiens
  Payload ID: 4460
  Gene Symbol: CYP4F12
  Gene Name: cytochrome P450, family 4, subfamily F, polypeptide 12
  ENSP ID: ENSP00000448560
MSLLSLPWLGLRPVATSPWLLLLLVVGSWLLARILAWTYAFYNNCRRLQCFPQPPKRNWFWGHLGLITPTEEGLKNSTQMSATYSQGFTVPEALAGRRDTAEWR

SEQ ID NO: 22102 - protein, 524 aa, Homo sapiens; identical to SEQ ID NO: 22097
  Payload ID: 4460
  Gene Symbol: CYP4F12
  Gene Name: cytochrome P450, family 4, subfamily F, polypeptide 12
  ENSP ID: ENSP00000448998

SEQ ID NO: 22103 - protein, 102 aa, Homo sapiens; identical to SEQ ID NO: 22098
  Payload ID: 4460
  Gene Symbol: CYP4F12
  Gene Name: cytochrome P450, family 4, subfamily F, polypeptide 12
  Uniprot ID: Q9HCS2
  ENSP ID: ENSP00000449703

SEQ ID NO: 22104 - protein, 520 aa, Homo sapiens
  Payload ID: 4461
  Gene Symbol: CYP4F2
  Gene Name: cytochrome P450, family 4, subfamily F, polypeptide 2
  ENSP ID: ENSP00000011989
MSQLSLSWLGLWPVAASPWLLLLLVGASWLLAHVLAWTYAFYDNCRRLRCFPQPPRRNWFWGHQGMIHSSEEGLLYTQSLACTFGDMGCWWVGPWQAVIHIFLPTCIKPVLFAPAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 22105 - protein, 520 aa, Homo sapiens
  Payload ID: 4461
  Gene Symbol: CYP4F2
  Gene Name: cytochrome P450, family 4, subfamily F, polypeptide 2
  Uniprot ID: P78329
  ENSP ID: ENSP00000221700
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 22106 - protein, 153 aa, Homo sapiens
  Payload ID: 4461
  Gene Symbol: CYP4F2
  Gene Name: cytochrome P450, family 4, subfamily F, polypeptide 2
  ENSP ID: ENSP00000465514
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTP

SEQ ID NO: 22107 - protein, 89 aa, Homo sapiens
  Payload ID: 4461
  Gene Symbol: CYP4F2
  Gene Name: cytochrome P450, family 4, subfamily F, polypeptide 2
  ENSP ID: ENSP00000467443
MSQLSLSWLGLWPVAASPWLLLLLVGASWLLAHVLAWTYAFYDNCRRLRCFPQPPRRNWFWGHQGMLPLHQRTSSSTASWSPGWGMGSC

SEQ ID NO: 22108 - protein, 74 aa, Homo sapiens
  Payload ID: 4461
  Gene Symbol: CYP4F2
  Gene Name: cytochrome P450, family 4, subfamily F, polypeptide 2
  ENSP ID: ENSP00000467846
  MOD_RES (1)..(1): Any amino acid
XWVLYHLAKHPEYQERCRQEVQELLKDREPKEIEWSTTPFALTQRTSRRGHLWLLFPSRQGPGTASGRRSRWRR

SEQ ID NO: 22109 - protein, 531 aa, Homo sapiens
  Payload ID: 4462
  Gene Symbol: CYP4F22
  Gene Name: cytochrome P450, family 4, subfamily F, polypeptide 22
  Uniprot ID: Q6NT55
  ENSP ID: ENSP00000269703
MLPITDRLLHLLGLEKTAFRIYAVSTLLLFLLFFLFRLLLRFLRLCRSFYITCRRLRCFPQPPRRNWLLGHLGMYLPNEAGLQDEKKVLDNMHHVLLVWMGPVLPLLVLVHPDYIKPLLGASAAIAPKDDLFYGFLKPWLGDGLLLSKGDKWSRHRRLLTPAFHFDILKPYMKIFNQSADIMHAKWRHLAEGSAVSLDMFEHISLMTLDSLQKCVFSYNSNCQEKMSDYISAIIELSALSVRRQYRLHHYLDFIYYRSADGRRFRQACDMVHHFTTEVIQERRRALRQQGAEAWLKAKQGKTLDFIDVLLLARDEDGKELSDEDIRAEADTFMFEGHDTTSSGISWMLFNLAKYPEYQEKCREEIQEVMKGRELEELEWDDLTQLPFTTMCIKESLRQYPPVTLVSRQCTEDIKLPDGRIIPKGIICLVSIYGTHHNPTVWPDSKVYNPYRFDPDNPQQRSPLAYVPFSAGPRNCIGQSFAMAELRVVVALTLLRFRLSVDRTRKVRRKPELILRTENGLWLKVEPLPPRA

SEQ ID NO: 22110 - protein, 531 aa, Homo sapiens; identical to SEQ ID NO: 22109
  Payload ID: 4462
  Gene Symbol: CYP4F22
  Gene Name: cytochrome P450, family 4, subfamily F, polypeptide 22
  Uniprot ID: Q6NT55
  ENSP ID: ENSP00000469866

SEQ ID NO: 22111 - protein, 520 aa, Homo sapiens
  Payload ID: 4463
  Gene Symbol: CYP4F3
  Gene Name: cytochrome P450, family 4, subfamily F, polypeptide 3
  Uniprot ID: Q08477
  ENSP ID: ENSP00000221307
MPQLSLSSLGLWPMAASPWLLLLLVGASWLLARILAWTYTFYDNCCRLRCFPQPPKRNWFLGHLGLIHSSEEGLLYTQSLACTFGDMCCWWVGPWHAIVRIFHPTYIKPVLFAPAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 22112 - protein, 79 aa, Homo sapiens
  Payload ID: 4463
  Gene Symbol: CYP4F3
  Gene Name: cytochrome P450, family 4, subfamily F, polypeptide 3
  ENSP ID: ENSP00000465394
MPQLSLSSLGLWPMAASPWLLLLLVGASWLLARILAWTYTFYDNCCRLRCFPQPPKRNWFLGHLGLLPLYQRTRSSTAS

SEQ ID NO: 22113 - protein, 520 aa, Homo sapiens
  Payload ID: 4463
  Gene Symbol: CYP4F3
  Gene Name: cytochrome P450, family 4, subfamily F, polypeptide 3
  Uniprot ID: Q08477
  ENSP ID: ENSP00000466395
MPQLSLSSLGLWPMAASPWLLLLLVGASWLLARILAWTYTFYDNCCRLRCFPQPPKRNWFLGHLGLVTPTEQGMRVLTQLVATYPQGFKVWMGPIFPVIRFCHPNIIRSVINASAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 22114 - protein, 520 aa, Homo sapiens; identical to SEQ ID NO: 22113
  Payload ID: 4463
  Gene Symbol: CYP4F3
  Gene Name: cytochrome P450, family 4, subfamily F, polypeptide 3
  Uniprot ID: Q08477
  ENSP ID: ENSP00000466988

SEQ ID NO: 22115 - protein, 520 aa, Homo sapiens; identical to SEQ ID NO: 22113
  Payload ID: 4463
  Gene Symbol: CYP4F3
  Gene Name: cytochrome P450, family 4, subfamily F, polypeptide 3
  Uniprot ID: Q08477
  ENSP ID: ENSP00000468105

SEQ ID NO: 22116 - protein, 74 aa, Homo sapiens
  Payload ID: 4463
  Gene Symbol: CYP4F3
  Gene Name: cytochrome P450, family 4, subfamily F, polypeptide 3
  ENSP ID: ENSP00000476546
ILLYIDFLYYLTPDGQRFRRACRLVHDFTDAVIQERRRTLPSQGVDDFLQAKAKSKTLDFIDVLLLSKVGLSGI

SEQ ID NO: 22117 - protein, 523 aa, Homo sapiens
  Payload ID: 4463
  Gene Symbol: CYP4F3
  Gene Name: cytochrome P450, family 4, subfamily F, polypeptide 3
  ENSP ID: ENSP00000478605
MSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLSVLQ

SEQ ID NO: 22118 - protein, 520 aa, Homo sapiens
  Payload ID: 4464
  Gene Symbol: CYP4F8
  Gene Name: cytochrome P450, family 4, subfamily F, polypeptide 8
  Uniprot ID: P98187
  ENSP ID: ENSP00000477567
MSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLLTPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 22119 - protein, 211 aa, Homo sapiens
  Payload ID: 4464
  Gene Symbol: CYP4F8
  Gene Name: cytochrome P450, family 4, subfamily F, polypeptide 8
  ENSP ID: ENSP00000478555
MGACRMSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLLTPAFHFNILKPYIKIFSKSANIMHAKWQRLAMEGSTCLDVFEHISLMTLDSLQKC

SEQ ID NO: 22120 - protein, 69 aa, Homo sapiens
  Payload ID: 4464
  Gene Symbol: CYP4F8
  Gene Name: cytochrome P450, family 4, subfamily F, polypeptide 8
  ENSP ID: ENSP00000479430
MSLLSLSWLGLRPVAASPWLLLLVVGASWLLARILAWTYAFYHNGRRLRCFPQPRKQNWFLGHLGLEAQ

SEQ ID NO: 22121 - protein, 103 aa, Homo sapiens
  Payload ID: 4464
  Gene Symbol: CYP4F8
  Gene Name: cytochrome P450, family 4, subfamily F, polypeptide 8
  ENSP ID: ENSP00000482692
  MOD_RES (1)..(1): Any amino acid
XLRLHPPIPTFARGCTQDVVLPDSRVIPKGNVCNINIFAIHHNPSVWPDPEVYDPFRFDPENAQKRSPMAFIPFSAGPREPRRTPEIVLRAEDGLWLRVEPLG

SEQ ID NO: 22122 - protein, 525 aa, Homo sapiens
  Payload ID: 4465
  Gene Symbol: CYP4V2
  Gene Name: cytochrome P450, family 4, subfamily V, polypeptide 2
  Uniprot ID: Q6ZWL3
  ENSP ID: ENSP00000368079
MAGLWLGLVWQKLLLWGAASALSLAGASLVLSLLQRVASYARKWQQMRPIPTVARAYPLVGHALLMKPDGREFFQQIIEYTEEYRHMPLLKLWVGPVPMVALYNAENVEVILTSSKQIDKSSMYKFLEPWLGLGLLTSTGNKWRSRRKMLTPTFHFTILEDFLDIMNEQANILVKKLEKHINQEAFNCFFYITLCALDIICETAMGKNIGAQSNDDSEYVRAVYRMSEMIFRRIKMPWLWLDLWYLMFKEGWEHKKSLQILHTFTNSVIAERANEMNANEDCRGDGRGSAPSKNKRRAFLDLLLSVTDDEGNRLSHEDIREEVDTFMFEGHDTTAAAINWSLYLLGSNPEVQKKVDHELDDVFGKSDRPATVEDLKKLRYLECVIKETLRLFPSVPLFARSVSEDCEVAGYRVLKGTEAVIIPYALHRDPRYFPNPEEFQPERFFPENAQGRHPYAYVPFSAGPRNCIGQKFAVMEEKTILSCILRHFWIESNQKREELGLEGQLILRPSNGIWIKLKRRNADER

SEQ ID NO: 22123 - protein, 509 aa, Homo sapiens
  Payload ID: 4466
  Gene Symbol: CYP4X1
  Gene Name: cytochrome P450, family 4, subfamily X, polypeptide 1
  Uniprot ID: Q8N118
  ENSP ID: ENSP00000360968
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 22124 - protein, 505 aa, Homo sapiens
  Payload ID: 4467
  Gene Symbol: CYP4Z1
  Gene Name: cytochrome P450, family 4, subfamily Z, polypeptide 1
  Uniprot ID: Q86W10
  ENSP ID: ENSP00000334246
MEPSWLQELMAHPFLLLILLCMSLLLFQVIRLYQRRRWMIRALHLFPAPPAHWFYGHKEFYPVKEFEVYHKLMEKYPCAVPLWVGPFTMFFSVHDPDYAKILLKRQDPKSAVSHKILESWVGRGLVTLDGSKWKKHRQIVKPGFNISILKIFITMMSESVRMMLNKWEEHIAQNSRLELFQHVSLMTLDSIMKCAFSHQGSIQLDSTLDSYLKAVFNLSKISNQRMNNFLHHNDLVFKFSSQGQIFSKFNQELHQFTEKVIQDRKESLKDKLKQDTTQKRRWDFLDILLSAKSENTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 22125 - protein, 500 aa, Homo sapiens
  Payload ID: 4468
  Gene Symbol: CYP46A1
  Gene Name: cytochrome P450, family 46, subfamily A, polypeptide 1
  Uniprot ID: Q9Y6A2
  ENSP ID: ENSP00000261835
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 22126 - protein, 403 aa, Homo sapiens
  Payload ID: 4468
  Gene Symbol: CYP46A1
  Gene Name: cytochrome P450, family 46, subfamily A, polypeptide 1
  Uniprot ID: Q9Y6A2
  ENSP ID: ENSP00000369577
MSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 22127 - protein, 96 aa, Homo sapiens
  Payload ID: 4468
  Gene Symbol: CYP46A1
  Gene Name: cytochrome P450, family 46, subfamily A, polypeptide 1
  ENSP ID: ENSP00000451069
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKFH

SEQ ID NO: 22128 - protein, 164 aa, Homo sapiens
  Payload ID: 4468
  Gene Symbol: CYP46A1
  Gene Name: cytochrome P450, family 46, subfamily A, polypeptide 1
  ENSP ID: ENSP00000451602
RFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLEQCASQLLGHLPRSERAGL

SEQ ID NO: 22129 - protein, 51 aa, Homo sapiens
  Payload ID: 4468
  Gene Symbol: CYP46A1
  Gene Name: cytochrome P450, family 46, subfamily A, polypeptide 1
  ENSP ID: ENSP00000452151
  MOD_RES (1)..(1): Any amino acid
XPAREEEAAPGGPGEHSLPAPGGQGLGPAPPGSPEEGRGGSCRHPHTDSES

SEQ ID NO: 22130 - protein, 509 aa, Homo sapiens
  Payload ID: 4469
  Gene Symbol: CYP51A1
  Gene Name: cytochrome P450, family 51, subfamily A, polypeptide 1
  ENSP ID: ENSP00000003100
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 22131 - protein, 222 aa, Homo sapiens
  Payload ID: 4469
  Gene Symbol: CYP51A1
  Gene Name: cytochrome P450, family 51, subfamily A, polypeptide 1
  ENSP ID: ENSP00000394268
  MOD_RES (1)..(1): Any amino acid
XRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQDNPASGEKFAYVPFGAGRHRCIGENFAYVQIKTIWSTMLRLYEFDLIDGYFPTVNYTTMIHTPENPVIRYKRRSK

SEQ ID NO: 22132 - protein, 404 aa, Homo sapiens
  Payload ID: 4469
  Gene Symbol: CYP51A1
  Gene Name: cytochrome P450, family 51, subfamily A, polypeptide 1
  Uniprot ID: Q16850
  ENSP ID: ENSP00000406757
MVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 22133 - protein, 30 aa, Homo sapiens
  Payload ID: 4469
  Gene Symbol: CYP51A1
  Gene Name: cytochrome P450, family 51, subfamily A, polypeptide 1
  ENSP ID: ENSP00000412536
MEDALFLRKSPPYIFSPIPFLGHAIAFGKS

SEQ ID NO: 22134 - protein, 504 aa, Homo sapiens
  Payload ID: 4470
  Gene Symbol: CYP7A1
  Gene Name: cytochrome P450, family 7, subfamily A, polypeptide 1
  Uniprot ID: P22680
  ENSP ID: ENSP00000301645
MMTTSLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPMDGNTTENINDTFIKTLQGHALNSLTESMMENLQRIMRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDENGKTKTTFYCNGLKLKYYYMPFGSGATICPGRLFAIHEIKQFLILMLSYFELELIEGQAKCPPLDQSRAGLGILPPLNDIEFKYKFKHL

SEQ ID NO: 22135 - protein, 506 aa, Homo sapiens
  Payload ID: 4471
  Gene Symbol: CYP7B1
  Gene Name: cytochrome P450, family 7, subfamily B, polypeptide 1
  Uniprot ID: O75881
  ENSP ID: ENSP00000310721
MAGEVSAATGRFSLERLGLPGLALAAALLLLALCLLVRRTRRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 22136 - protein, 501 aa, Homo sapiens
  Payload ID: 4472
  Gene Symbol: CYP8B1
  Gene Name: cytochrome P450, family 8, subfamily B, polypeptide 1
  Uniprot ID: Q9UNU6
  ENSP ID: ENSP00000318867
MVLWGPVLGALLVVIAGYLCLPGMLRQRRPWEPPLDKGTVPWLGHAMAFRKNMFEFLKRMRTKHGDVFTVQLGGQYFTFVMDPLSFGSILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEVKLFILLMVTHFDLELVDPDTPLPHVDPQRWGFGTMQPSHDVRFRYRLHPTE

SEQ ID NO: 22137 - protein, 496 aa, Homo sapiens
  Payload ID: 4472
  Gene Symbol: CYP8B1
  Gene Name: cytochrome P450, family 8, subfamily B, polypeptide 1
  ENSP ID: ENSP00000404499
MVLWGPVLGALLVVIAGYLCLPGMLRQRRPWEPPLDKGTVPWLGHAMAFRKNMFEFLKRMRTKHGDVFTVQLGGQYFTFVMDPLSFGSILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEADFERNVDSGPQLTQSIYDTMISWLMELFSAAETEPLLREPWSPPTL

SEQ ID NO: 22138 - protein, 190 aa, Homo sapiens
  Payload ID: 4473
  Gene Symbol: CYGB
  Gene Name: cytoglobin
  Uniprot ID: Q8WWM9
  ENSP ID: ENSP00000293230
MEKVPGEMEIERRERSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 22139 - protein, 125 aa, Homo sapiens
  Payload ID: 4473
  Gene Symbol: CYGB
  Gene Name: cytoglobin
  ENSP ID: ENSP00000464817
MEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 22140 - protein, 226 aa, Homo sapiens
  Payload ID: 4473
  Gene Symbol: CYGB
  Gene Name: cytoglobin
  ENSP ID: ENSP00000466448
MEKVPGEMEIERRERSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKPTGHTALFGAVGPLTPPPSLAAPRAEGRVLKTLLDAPFLGAKEAGGIPDSTSPKEASVAARVPPWSCWEAALAAWMLTPARRAERGPLFLAFLLTVRERPS

SEQ ID NO: 22141 - protein, 125 aa, Homo sapiens; identical to SEQ ID NO: 22139
  Payload ID: 4473
  Gene Symbol: CYGB
  Gene Name: cytoglobin
  ENSP ID: ENSP00000468559

SEQ ID NO: 22142 - protein, 398 aa, Homo sapiens
  Payload ID: 4474
  Gene Symbol: CYTH1
  Gene Name: cytohesin 1
  Uniprot ID: Q15438
  ENSP ID: ENSP00000354398
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 22143 - protein, 398 aa, Homo sapiens; identical to SEQ ID NO: 22142
  Payload ID: 4474
  Gene Symbol: CYTH1
  Gene Name: cytohesin 1
  Uniprot ID: Q15438
  ENSP ID: ENSP00000389095

SEQ ID NO: 22144 - protein, 64 aa, Homo sapiens
  Payload ID: 4474
  Gene Symbol: CYTH1
  Gene Name: cytohesin 1
  ENSP ID: ENSP00000465252
MEEDDSYVPSDLTAEERQELENIRRRKQELLADIQRLKDEIAEVANEIENLGSTEESFSFCYFF

SEQ ID NO: 22145 - protein, 104 aa, Homo sapiens
  Payload ID: 4474
  Gene Symbol: CYTH1
  Gene Name: cytohesin 1
  ENSP ID: ENSP00000465530
MQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDR

SEQ ID NO: 22146 - protein, 397 aa, Homo sapiens
  Payload ID: 4474
  Gene Symbol: CYTH1
  Gene Name: cytohesin 1
  Uniprot ID: Q15438
  ENSP ID: ENSP00000465665
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 22147 - protein, 339 aa, Homo sapiens
  Payload ID: 4474
  Gene Symbol: CYTH1
  Gene Name: cytohesin 1
  Uniprot ID: Q15438
  ENSP ID: ENSP00000465940
MQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 22148 - protein, 11 aa, Homo sapiens
  Payload ID: 4474
  Gene Symbol: CYTH1
  Gene Name: cytohesin 1
  ENSP ID: ENSP00000465945
MEEDDSYEAEG

SEQ ID NO: 22149 - protein, 339 aa, Homo sapiens; identical to SEQ ID NO: 22147
  Payload ID: 4474
  Gene Symbol: CYTH1
  Gene Name: cytohesin 1
  Uniprot ID: Q15438
  ENSP ID: ENSP00000466512

SEQ ID NO: 22150 - protein, 86 aa, Homo sapiens
  Payload ID: 4474
  Gene Symbol: CYTH1
  Gene Name: cytohesin 1
  ENSP ID: ENSP00000466949
MQRNKQVAMGRKKFNMDPKKGIQFLIENDLLKNTCEDIAQFLYKGEGLNKTAIGDYLGERDEFNIQVLHAFVELHEFTDLNLVQAL

SEQ ID NO: 22151 - protein, 272 aa, Homo sapiens
  Payload ID: 4474
  Gene Symbol: CYTH1
  Gene Name: cytohesin 1
  ENSP ID: ENSP00000467052
MVLKTEEEDVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKL

SEQ ID NO: 22152 - protein, 194 aa, Homo sapiens
  Payload ID: 4474
  Gene Symbol: CYTH1
  Gene Name: cytohesin 1
  ENSP ID: ENSP00000468433
MHSPGGLGRPCLLQPCPAVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQST

SEQ ID NO: 22153 - protein, 359 aa, Homo sapiens
  Payload ID: 4475
  Gene Symbol: CYTIP
  Gene Name: cytohesin 1 interacting protein
  Uniprot ID: O60759
  ENSP ID: ENSP00000264192
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 22154 - protein, 131 aa, Homo sapiens
  Payload ID: 4475
  Gene Symbol: CYTIP
  Gene Name: cytohesin 1 interacting protein
  ENSP ID: ENSP00000394308
MFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDR

SEQ ID NO: 22155 - protein, 36 aa, Homo sapiens
  Payload ID: 4475
  Gene Symbol: CYTIP
  Gene Name: cytohesin 1 interacting protein
  ENSP ID: ENSP00000402155
MDDNRRIQMLADTVATLPRGRKQLALTRSSSLSDFS

SEQ ID NO: 22156 - protein, 74 aa, Homo sapiens
  Payload ID: 4475
  Gene Symbol: CYTIP
  Gene Name: cytohesin 1 interacting protein
  ENSP ID: ENSP00000402771
MDDNRRIQMLADTVATLPRGRKQLALTRSSSLSDFSWSQRKLVTVEKQDNETFGFEIQSYRPQNQNACSSEMFT

SEQ ID NO: 22157 - protein, 61 aa, Homo sapiens
  Payload ID: 4475
  Gene Symbol: CYTIP
  Gene Name: cytohesin 1 interacting protein
  ENSP ID: ENSP00000407205
MSLQRLLQHSSNGNLADFCAGPAYSSYSTLTGSLTMDDNRRIQMLADTVATLPRGRKQNDF

SEQ ID NO: 22158 - protein, 254 aa, Homo sapiens
  Payload ID: 4476
  Gene Symbol: CYTH2
  Gene Name: cytohesin 2
  ENSP ID: ENSP00000314566
MDPVVRITRSPATSPVMESENQGLSPLPKPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLR

SEQ ID NO: 22159 - protein, 292 aa, Homo sapiens
  Payload ID: 4476
  Gene Symbol: CYTH2
  Gene Name: cytohesin 2
  ENSP ID: ENSP00000375753
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGTGPGEDVEAALVYPHRQLPLLL

SEQ ID NO: 22160 - protein, 399 aa, Homo sapiens
  Payload ID: 4476
  Gene Symbol: CYTH2
  Gene Name: cytohesin 2
  Uniprot ID: Q99418
  ENSP ID: ENSP00000408236
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 22161 - protein, 214 aa, Homo sapiens
  Payload ID: 4476
  Gene Symbol: CYTH2
  Gene Name: cytohesin 2
  ENSP ID: ENSP00000472602
LLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGTCPPDPAGPSAGGHLWAWALDSASAHTCCLN

SEQ ID NO: 22162 - protein, 139 aa, Homo sapiens
  Payload ID: 4476
  Gene Symbol: CYTH2
  Gene Name: cytohesin 2
  ENSP ID: ENSP00000482082
MVAPLQSSLGNRARPRLYKIKHANHCPANTPVQIPAFDPREADCWGKLRVLEVPLAVSGQKEKQEGASITRNCFPQSAGITGVSHRARPQPTSFGWQWFGYRLSSLKFMLRFEPQCGRCWDVGPHRSCVVLEVESSWID

SEQ ID NO: 22163 - protein, 400 aa, Homo sapiens
  Payload ID: 4476
  Gene Symbol: CYTH2
  Gene Name: cytohesin 2
  ENSP ID: ENSP00000486578
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLAGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 22164 - protein, 399 aa, Homo sapiens
  Payload ID: 4477
  Gene Symbol: CYTH3
  Gene Name: cytohesin 3
  Uniprot ID: O43739
  ENSP ID: ENSP00000297044
MDEDGGGEGGGVPEDLSLEEREELLDIRRRKKELIDDIERLKYEIAEVMTEIDNLTSVEESKTTQRNKQIAMGRKKFNMDPKKGIQFLIENDLLQSSPEDVAQFLYKGEGLNKTVIGDYLGERDEFNIKVLQAFVELHEFADLNLVQALRQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 22165 - protein, 400 aa, Homo sapiens
  Payload ID: 4477
  Gene Symbol: CYTH3
  Gene Name: cytohesin 3
  Uniprot ID: O43739
  ENSP ID: ENSP00000379967
MDEDGGGEGGGVPEDLSLEEREELLDIRRRKKELIDDIERLKYEIAEVMTEIDNLTSVEESKTTQRNKQIAMGRKKFNMDPKKGIQFLIENDLLQSSPEDVAQFLYKGEGLNKTVIGDYLGERDEFNIKVLQAFVELHEFADLNLVQALRQFLWSFRLPGEAQKIDRMMEAFASRYCLCNPGVFQSTDTCYVLSFAIIMLNTSLHNHNVRDKPTAERFIAMNRGINEGGDLPEELLRNLYESIKNEPFKIPEDDGNDLTHTFFNPDREGWLLKLGGGRVKTWKRRWFILTDNCLYYFEYTTDKEPRGIIPLENLSIREVEDPRKPNCFELYNPSHKGQVIKACKTEADGRVVEGNHVVYRISAPSPEEKEEWMKSIKASISRDPFYDMLATRKRRIANKK

SEQ ID NO: 22166 - protein, 394 aa, Homo sapiens
  Payload ID: 4478
  Gene Symbol: CYTH4
  Gene Name: cytohesin 4
  Uniprot ID: Q9UIA0
  ENSP ID: ENSP00000248901
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRNLFDSIKSEPFSIPEDDGNDLTHTFFNPDREGWLLKLGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 22167 - protein, 157 aa, Homo sapiens
  Payload ID: 4478
  Gene Symbol: CYTH4
  Gene Name: cytohesin 4
  ENSP ID: ENSP00000384280
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRFREGASDLGFGG

SEQ ID NO: 22168 - protein, 154 aa, Homo sapiens
  Payload ID: 4478
  Gene Symbol: CYTH4
  Gene Name: cytohesin 4
  ENSP ID: ENSP00000385997
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRVVKTKWESV

SEQ ID NO: 22169 - protein, 117 aa, Homo sapiens
  Payload ID: 4478
  Gene Symbol: CYTH4
  Gene Name: cytohesin 4
  ENSP ID: ENSP00000405442
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGE

SEQ ID NO: 22170 - protein, 147 aa, Homo sapiens
  Payload ID: 4478
  Gene Symbol: CYTH4
  Gene Name: cytohesin 4
  ENSP ID: ENSP00000409579
  MOD_RES (1)..(1): Any amino acid
XTHTSGSLSSRDSQAGDSASRAGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 22171 - protein, 312 aa, Homo sapiens
  Payload ID: 4479
  Gene Symbol: CIAPIN1
  Gene Name: cytokine induced apoptosis inhibitor 1
  Uniprot ID: Q6FI81
  ENSP ID: ENSP00000377914
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 22172 - protein, 266 aa, Homo sapiens
  Payload ID: 4479
  Gene Symbol: CIAPIN1
  Gene Name: cytokine induced apoptosis inhibitor 1
  ENSP ID: ENSP00000454480
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMHLWPCRRTGKREVKGTDELPTQVSLWKLLPGRCLPLCQLPLPWDASLQTWGKGASE

SEQ ID NO: 22173 - protein, 239 aa, Homo sapiens
  Payload ID: 4479
  Gene Symbol: CIAPIN1
  Gene Name: cytokine induced apoptosis inhibitor 1
  ENSP ID: ENSP00000455309
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETALQREPLTPEEVQSVREHLGHESDNLLFVQITGKKPNFEVGSSRQLKLSITKKSSPSVKPAVDPAAAKLWTLSANDMEDDSMHLWPCRRTGKREVKGTDELPTQVSLWKLLPGRCLPLCQLPLPWDASLQTWGKGASE

SEQ ID NO: 22174 - protein, 129 aa, Homo sapiens
  Payload ID: 4479
  Gene Symbol: CIAPIN1
  Gene Name: cytokine induced apoptosis inhibitor 1
  ENSP ID: ENSP00000455572
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKE

SEQ ID NO: 22175 - protein, 299 aa, Homo sapiens
  Payload ID: 4479
  Gene Symbol: CIAPIN1
  Gene Name: cytokine induced apoptosis inhibitor 1
  Uniprot ID: Q6FI81
  ENSP ID: ENSP00000456114
MADFGISAGQFVAVVWDKSSPVEALKGLVDKLQALTGNEGRVSVENIKQLLQCLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 22176 - protein, 266 aa, Homo sapiens; identical to SEQ ID NO: 22172
  Payload ID: 4479
  Gene Symbol: CIAPIN1
  Gene Name: cytokine induced apoptosis inhibitor 1
  ENSP ID: ENSP00000457042

SEQ ID NO: 22177 - protein, 48 aa, Homo sapiens
  Payload ID: 4479
  Gene Symbol: CIAPIN1
  Gene Name: cytokine induced apoptosis inhibitor 1
  ENSP ID: ENSP00000457318
MEDDSMDLIDSDELLDPEDLKKPDPASLRAASCGEGKKRKACKNCTCG

SEQ ID NO: 22178 - protein, 72 aa, Homo sapiens
  Payload ID: 4479
  Gene Symbol: CIAPIN1
  Gene Name: cytokine induced apoptosis inhibitor 1
  ENSP ID: ENSP00000457400
MEDDSMDLIDSDELLDPEDLKKPDPASLRAASCGEGKKRKACKNCTCGLAEELEKEKSREQMSSQPKSACGN

SEQ ID NO: 22179 - protein, 188 aa, Homo sapiens
  Payload ID: 4479
  Gene Symbol: CIAPIN1
  Gene Name: cytokine induced apoptosis inhibitor 1
  ENSP ID: ENSP00000457622
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSGSH

SEQ ID NO: 22180 - protein, 246 aa, Homo sapiens
  Payload ID: 4479
  Gene Symbol: CIAPIN1
  Gene Name: cytokine induced apoptosis inhibitor 1
  ENSP ID: ENSP00000458000
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMCYLGDAFRCASCPYLGMPAFKPGEKVLLSDSNLHDA

SEQ ID NO: 22181 - protein, 258 aa, Homo sapiens
  Payload ID: 4480
  Gene Symbol: CISH
  Gene Name: cytokine inducible SH2-containing protein
  Uniprot ID: Q9NSE2
  ENSP ID: ENSP00000294173
MVLCVQGPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 22182 - protein, 275 aa, Homo sapiens
  Payload ID: 4480
  Gene Symbol: CISH
  Gene Name: cytokine inducible SH2-containing protein
  Uniprot ID: Q9NSE2
  ENSP ID: ENSP00000409346
MYLEHTSHCPHHDDDTAMDTPLPRPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 22183 - protein, 422 aa, Homo sapiens
  Payload ID: 4481
  Gene Symbol: CRLF1
  Gene Name: cytokine receptor-like factor 1
  Uniprot ID: O75462
  ENSP ID: ENSP00000376188
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 22184 - protein, 173 aa, Homo sapiens
  Payload ID: 4481
  Gene Symbol: CRLF1
  Gene Name: cytokine receptor-like factor 1
  ENSP ID: ENSP00000470625
  MOD_RES (1)..(1): Any amino acid
XQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWKRPGPGGGACEPRGGEPSSGPVRR

SEQ ID NO: 22185 - protein, 371 aa, Homo sapiens
  Payload ID: 4482
  Gene Symbol: CRLF2
  Gene Name: cytokine receptor-like factor 2
  Uniprot ID: Q9HC73
  ENSP ID: ENSP00000370978
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 22186 - protein, 259 aa, Homo sapiens
  Payload ID: 4482
  Gene Symbol: CRLF2
  Gene Name: cytokine receptor-like factor 2
  Uniprot ID: Q9HC73
  ENSP ID: ENSP00000370979
MVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 22187 - protein, 371 aa, Homo sapiens; identical to SEQ ID NO: 22185
  Payload ID: 4482
  Gene Symbol: CRLF2
  Gene Name: cytokine receptor-like factor 2
  Uniprot ID: Q9HC73
  ENSP ID: ENSP00000383641

SEQ ID NO: 22188 - protein, 232 aa, Homo sapiens
  Payload ID: 4482
  Gene Symbol: CRLF2
  Gene Name: cytokine receptor-like factor 2
  ENSP ID: ENSP00000485269
MGRLVLLWGAAVFLLGGWMALGQGGAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQTQSRSVTQAGVQWCDLCLLQPSPPRFKRFSCLSLPSSWDYRHPPPRLANFCIISRDGVSPCWPGWSRTCDLR

SEQ ID NO: 22189 - protein, 442 aa, Homo sapiens
  Payload ID: 4483
  Gene Symbol: CRLF3
  Gene Name: cytokine receptor-like factor 3
  Uniprot ID: Q8IUI8
  ENSP ID: ENSP00000318804
MRGAMELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 22190 - protein, 96 aa, Homo sapiens
  Payload ID: 4483
  Gene Symbol: CRLF3
  Gene Name: cytokine receptor-like factor 3
  ENSP ID: ENSP00000462643
MRGAMELEPELLLQEARENVEAAQSYRRELGHRLEGLREARRQVKSPCLVVWEKRMRNCGALPKRPRTFSWTAYQKYLYWLMCLVYLLSWMTQFLT

SEQ ID NO: 22191 - protein, 118 aa, Homo sapiens
  Payload ID: 4483
  Gene Symbol: CRLF3
  Gene Name: cytokine receptor-like factor 3
  ENSP ID: ENSP00000463689
  MOD_RES (1)..(1): Any amino acid
XGVCAEKQDGYDSLQRDQAVCISTNGAVFVNGKEMTNQLPAVTSGSTVTFDIEAVTLGTTSNNEGGHFKLRERGLAMLSKLVSNSWAQSLRTLDSQSVRVTESRCHQAGLQWHDLNSL

SEQ ID NO: 22192 - protein, 428 aa, Homo sapiens
  Payload ID: 4484
  Gene Symbol: CLNK
  Gene Name: cytokine-dependent hematopoietic cell linker
  Uniprot ID: Q7Z7G1
  ENSP ID: ENSP00000226951
MNRQGNRKTTKEGSNDLKFQNFSLPKNRSWPRINSATGQYQRMNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIKGDASVRKNKIPLPPPRPLITLPKKYQPLPPEPESSRPPLSQRHTFPEVQRMPSQISLRDLSEVLEAEKVPHNQRKPESTHLLENQNTQEIPLAISSSSFTTSNHSVQNRDHRGGMQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKNFPIILIDGKDKTGVHRKQCHLTQPLPLTRHLLPL

SEQ ID NO: 22193 - protein, 428 aa, Homo sapiens [sequence omitted]

SEQ ID NO: 22194 - protein, 169 aa, Homo sapiens
  Payload ID: 4484
  Gene Symbol: CLNK
  Gene Name: cytokine-dependent hematopoietic cell linker
  Uniprot ID: Q7Z7G1
  ENSP ID: ENSP00000427208
MNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIKGDASVRKNKIPLPPPRPLITLPKKYQPLPPEPESSRPPLSQRHTFPEVQRMPSQISLRDLSEP

SEQ ID NO: 22195 - protein, 166 aa, Homo sapiens
  Payload ID: 4484
  Gene Symbol: CLNK
  Gene Name: cytokine-dependent hematopoietic cell linker
  ENSP ID: ENSP00000427256
MQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKNFPIILIDGKDKTGVHRKQCHLTQPLPLTRHLLPL

SEQ ID NO: 22196 - protein, 136 aa, Homo sapiens
  Payload ID: 4485
  Gene Symbol: CYTL1
  Gene Name: cytokine-like 1
  Uniprot ID: Q9NRR1
  ENSP ID: ENSP00000303550
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 22197 - protein, 92 aa, Homo sapiens
  Payload ID: 4485
  Gene Symbol: CYTL1
  Gene Name: cytokine-like 1
  ENSP ID: ENSP00000421743
  MOD_RES (1)..(1): Any amino acid
XTPGPLPVLLLLLAGAPAARPTPPTCYSRMRALSQEITRDFNLLQVSEPSEPCVRYLPRLYLDIHDLVFLLDDCNALEYPIPVTTVLPDRQR

SEQ ID NO: 22198 - protein, 76 aa, Homo sapiens
  Payload ID: 4485
  Gene Symbol: CYTL1
  Gene Name: cytokine-like 1
  ENSP ID: ENSP00000425397
  MOD_RES (1)..(1): Any amino acid
XPGPLPVLLLLLAGAPAARPTPPTCYSRMRALSQEITRDFNLLQVSEPSDLVFLLDDCNALEYPIPVTTVLPDRQR

SEQ ID NO: 22199 - protein, 176 aa, Homo sapiens
  Payload ID: 4486
  Gene Symbol: CYFIP1
  Gene Name: cytoplasmic FMR1 interacting protein 1
  ENSP ID: ENSP00000453060
PFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVVCG

SEQ ID NO: 22200 - protein, 151 aa, Homo sapiens
  Payload ID: 4486
  Gene Symbol: CYFIP1
  Gene Name: cytoplasmic FMR1 interacting protein 1
  ENSP ID: ENSP00000478377
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKD

SEQ ID NO: 22201 - protein, 1253 aa, Homo sapiens
  Payload ID: 4486
  Gene Symbol: CYFIP1
  Gene Name: cytoplasmic FMR1 interacting protein 1
  Uniprot ID: Q7L576
  ENSP ID: ENSP00000478779
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 22202 - protein, 185 aa, Homo sapiens
  Payload ID: 4486
  Gene Symbol: CYFIP1
  Gene Name: cytoplasmic FMR1 interacting protein 1
  ENSP ID: ENSP00000479802
  MOD_RES (1)..(1): Any amino acid
XYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYLVRTMAESLGSAELLRQLKSLGMERLLHAVNTFLRQSCTYLPLLTFGETLQQCCDLSQLWFREFFL

SEQ ID NO: 22203 - protein, 161 aa, Homo sapiens
  Payload ID: 4486
  Gene Symbol: CYFIP1
  Gene Name: cytoplasmic FMR1 interacting protein 1
  ENSP ID: ENSP00000480307
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITL

SEQ ID NO: 22204 - protein, 822 aa, Homo sapiens
  Payload ID: 4486
  Gene Symbol: CYFIP1
  Gene Name: cytoplasmic FMR1 interacting protein 1
  Uniprot ID: Q7L576
  ENSP ID: ENSP00000480525
MAESLGSAELLRQLKSLGMERLLHAVNTFLRQSCTYLPLLTFGGKTSFVSLDVYGTEANCSATSCSFPKAAATWPRRQAPGPLGELVRGPPDQGVAEQSFSHGLFEFGITNVPCIFSPPQMFPWIIQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 22205 - protein, 77 aa, Homo sapiens
  Payload ID: 4486
  Gene Symbol: CYFIP1
  Gene Name: cytoplasmic FMR1 interacting protein 1
  ENSP ID: ENSP00000480596
MAAQVTLEDALSNVDLLEELPLPDQQPCIEPPPSSLLYQPNFNTNFEDRNAFVTGIARYIEQATVHSSMCKNNTCWF

SEQ ID NO: 22206 - protein, 1253 aa, Homo sapiens; identical to SEQ ID NO: 22201
  Payload ID: 4486
  Gene Symbol: CYFIP1
  Gene Name: cytoplasmic FMR1 interacting protein 1
  Uniprot ID: Q7L576
  ENSP ID: ENSP00000481038

SEQ ID NO: 22207 - protein, 45 aa, Homo sapiens
  Payload ID: 4486
  Gene Symbol: CYFIP1
  Gene Name: cytoplasmic FMR1 interacting protein 1
  ENSP ID: ENSP00000482459
  MOD_RES (1)..(1): Any amino acid
XCDWETGHEPFNDPALRGEKDPKSGFDIKVPRRAVGPSSTQVLVP

SEQ ID NO: 22208 - protein, 185 aa, Homo sapiens; identical to SEQ ID NO: 22202
  Payload ID: 4486
  Gene Symbol: CYFIP1
  Gene Name: cytoplasmic FMR1 interacting protein 1
  ENSP ID: ENSP00000485841
  MOD_RES (1)..(1): Any amino acid

SEQ ID NO: 22209 - protein, 862 aa, Homo sapiens
  Payload ID: 4486
  Gene Symbol: CYFIP1
  Gene Name: cytoplasmic FMR1 interacting protein 1
  ENSP ID: ENSP00000486145
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDSFDAMFREANHNVSAPYGRITLHVFWELNYDFLPNYCYNGSTN

SEQ ID NO: 22210 - protein, 862 aa, Homo sapiens; identical to SEQ ID NO: 22209
  Payload ID: 4486
  Gene Symbol: CYFIP1
  Gene Name: cytoplasmic FMR1 interacting protein 1
  ENSP ID: ENSP00000486555

SEQ ID NO: 22211 - protein, 77 aa, Homo sapiens
  Payload ID: 4486
  Gene Symbol: CYFIP1
  Gene Name: cytoplasmic FMR1 interacting protein 1
  ENSP ID: ENSP00000486724
MAAQVTLEDALSNVDLLEELPLPDQQPCIEPPPSSLLYQPNFNTNFEDRNAFVTGIARYIEQATVHSSMYKNNTCWF

SEQ ID NO: 22212 - protein, 45 aa, Homo sapiens; identical to SEQ ID NO: 22207
  Payload ID: 4486
  Gene Symbol: CYFIP1
  Gene Name: cytoplasmic FMR1 interacting protein 1
  ENSP ID: ENSP00000486951
  MOD_RES (1)..(1): Any amino acid

SEQ ID NO: 22213 - protein, 161 aa, Homo sapiens; identical to SEQ ID NO: 22203
  Payload ID: 4486
  Gene Symbol: CYFIP1
  Gene Name: cytoplasmic FMR1 interacting protein 1
  ENSP ID: ENSP00000487107

SEQ ID NO: 22214 - protein, 151 aa, Homo sapiens; identical to SEQ ID NO: 22200
  Payload ID: 4486
  Gene Symbol: CYFIP1
  Gene Name: cytoplasmic FMR1 interacting protein 1
  ENSP ID: ENSP00000487156

SEQ ID NO: 22215 - protein, 1117 aa, Homo sapiens
  Payload ID: 4487
  Gene Symbol: CYFIP2
  Gene Name: cytoplasmic FMR1 interacting protein 2
  ENSP ID: ENSP00000403793
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 22216 - protein, 1057 aa, Homo sapiens
  Payload ID: 4487
  Gene Symbol: CYFIP2
  Gene Name: cytoplasmic FMR1 interacting protein 2
  ENSP ID: ENSP00000428009
MTTHVTLEDALSNVDLLEELPLPDQQPCIEPPPSSIMYQANFDTNFEDRNAFVTGIARYIEQATVHSSMVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 22217 - protein, 68 aa, Homo sapiens
  Payload ID: 4487
  Gene Symbol: CYFIP2
  Gene Name: cytoplasmic FMR1 interacting protein 2
  ENSP ID: ENSP00000428079
MTTHVTLEDALSNVDLLEELPLPDQQPCIEPPPSSIMYQANFDTNFEDRNAFVTGIASARPSSGSAAR

SEQ ID NO: 22218 - protein, 1227 aa, Homo sapiens
  Payload ID: 4487
  Gene Symbol: CYFIP2
  Gene Name: cytoplasmic FMR1 interacting protein 2
  ENSP ID: ENSP00000430904
MTTHVTLEDALSNVDLLEELPLPDQQPCIEPPPSSIMYQANFDTNFEDRNAFVTGIARYIEQATVHSSMVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 22219 - protein, 222 aa, Homo sapiens
  Payload ID: 4487
  Gene Symbol: CYFIP2
  Gene Name: cytoplasmic FMR1 interacting protein 2
  ENSP ID: ENSP00000478058
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQ

SEQ ID NO: 22220 - protein, 71 aa, Homo sapiens
  Payload ID: 4487
  Gene Symbol: CYFIP2
  Gene Name: cytoplasmic FMR1 interacting protein 2
  ENSP ID: ENSP00000479211
MTTHVTLEDALSNVDLLEELPLPDQQPCIEPPPSSIMYQANFDTNFEDRNAFVTGIARYIEQATVHSSMIF

SEQ ID NO: 22221 - protein, 188 aa, Homo sapiens
  Payload ID: 4487
  Gene Symbol: CYFIP2
  Gene Name: cytoplasmic FMR1 interacting protein 2
  ENSP ID: ENSP00000479376
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAY

SEQ ID NO: 22222 - protein, 1278 aa, Homo sapiens
  Payload ID: 4487
  Gene Symbol: CYFIP2
  Gene Name: cytoplasmic FMR1 interacting protein 2
  Uniprot ID: Q96F07
  ENSP ID: ENSP00000479719
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 22223 - protein, 1253 aa, Homo sapiens
  Payload ID: 4487
  Gene Symbol: CYFIP2
  Gene Name: cytoplasmic FMR1 interacting protein 2
  Uniprot ID: Q96F07
  ENSP ID: ENSP00000479968
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 22224 - protein, 295 aa, Homo sapiens
  Payload ID: 4487
  Gene Symbol: CYFIP2
  Gene Name: cytoplasmic FMR1 interacting protein 2
  ENSP ID: ENSP00000480605
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQQLEVIPGYEELLADIVNICVDYYENKMYLTPSEKHMLLKVMGFGLYLMDGNVSNIYKLDAKKRINLSKIDKFF

SEQ ID NO: 22225 - protein, 101 aa, Homo sapiens
  Payload ID: 4487
  Gene Symbol: CYFIP2
  Gene Name: cytoplasmic FMR1 interacting protein 2
  ENSP ID: ENSP00000482739
LYMVRTMLESLIADKSGSKKTLRSSLDGPIVLAIEDFHKQSFFFTHLLNISDGVLLCCPGWSAVALSQLTATSASQVQAGVQSCDLSSPQPLPPRSPAAVL

SEQ ID NO: 22226 - protein, 234 aa, Homo sapiens
  Payload ID: 4487
  Gene Symbol: CYFIP2
  Gene Name: cytoplasmic FMR1 interacting protein 2
  ENSP ID: ENSP00000483307
MAGSVLLDKRFRAECKNYGVIIPYPPSNRYETLLKQRHVQLLGRSIDLNRLITQRISAAMYKSLDQAISRFESEDLTSIVELEWTKVTIRIKRPLNCPHGFLSLFHALLTHRLLCKHMTLDSFDAMFREANHNVSAPYGRITLHVFWELNFDFLPNYCYNGSTNRFVRTASFHPRTTTRQTCQRPALLPLWIQASQHCLQPHLQLLQEFRGATSFQDYADSWVIRASLWSWRNC

SEQ ID NO: 22227 - protein, 1253 aa, Homo sapiens; identical to SEQ ID NO: 22223
  Payload ID: 4487
  Gene Symbol: CYFIP2
  Gene Name: cytoplasmic FMR1 interacting protein 2
  Uniprot ID: Q96F07
  ENSP ID: ENSP00000484819

SEQ ID NO: 22228 - protein, 1538 aa, Homo sapiens
  Payload ID: 4488
  Gene Symbol: CLASP1
  Gene Name: cytoplasmic linker associated protein 1
  Uniprot ID: Q7Z460
  ENSP ID: ENSP00000263710
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLARSSRIPRPSMSQGCSRDTSRESSRDTSPARGFPPLDRFGLGQPGRIPGSVNAMRVLSTSTDLEAAVADALKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSRLWGWSADGLAKHPPPFSQPNSIPTAPSHKALRRSYSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22229 - protein, 1479 aa, Homo sapiens
  Payload ID: 4488
  Gene Symbol: CLASP1
  Gene Name: cytoplasmic linker associated protein 1
  Uniprot ID: Q7Z460
  ENSP ID: ENSP00000380717
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLDGTTTKAEGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22230 - protein, 1471 aa, Homo sapiens
  Payload ID: 4488
  Gene Symbol: CLASP1
  Gene Name: cytoplasmic linker associated protein 1
  Uniprot ID: Q7Z460
  ENSP ID: ENSP00000386442
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22231 - protein, 1478 aa, Homo sapiens
  Payload ID: 4488
  Gene Symbol: CLASP1
  Gene Name: cytoplasmic linker associated protein 1
  ENSP ID: ENSP00000389372
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLDGTTTKAEGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22232 - protein, 150 aa, Homo sapiens
  Payload ID: 4488
  Gene Symbol: CLASP1
  Gene Name: cytoplasmic linker associated protein 1
  ENSP ID: ENSP00000392886
MIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLR

SEQ ID NO: 22233 - protein, 1275 aa, Homo sapiens
  Payload ID: 4488
  Gene Symbol: CLASP1
  Gene Name: cytoplasmic linker associated protein 1
  ENSP ID: ENSP00000400562
  MOD_RES (1)..(1): Any amino acid
XTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLGRIRTRRQSSGSATNVASTPDNRGRSRAKVVSQSQRSRSANPAGAGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKIADSEAECEDKEGNLFPSEVSCTRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22234 - protein, 110 aa, Homo sapiens
  Payload ID: 4488
  Gene Symbol: CLASP1
  Gene Name: cytoplasmic linker associated protein 1
  ENSP ID: ENSP00000402101
MIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQR

SEQ ID NO: 22235 - protein, 1477 aa, Homo sapiens
  Payload ID: 4488
  Gene Symbol: CLASP1
  Gene Name: cytoplasmic linker associated protein 1
  Uniprot ID: Q7Z460
  ENSP ID: ENSP00000441625
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLESRHMREDMEYIGLDSGRIRTRRQSSGSATNVASTPDNRGRSRAKVVSQSQPGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 22236 - protein, 431 aa, Homo sapiens
  Payload ID: 4489
  Gene Symbol: CLASP2
  Gene Name: cytoplasmic linker associated protein 2
  Uniprot ID: O75122
  ENSP ID: ENSP00000324364
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLECEAFWRSGRTAKLYSV

SEQ ID NO: 22237 - protein, 458 aa, Homo sapiens
  Payload ID: 4489
  Gene Symbol: CLASP2
  Gene Name: cytoplasmic linker associated protein 2
  ENSP ID: ENSP00000327760
MLIQRTFISYYISYQNKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGKRTDYGKLYHVLSLISVKTSSYTLIISIHSCYLRIVHMF

SEQ ID NO: 22238 - protein, 1515 aa, Homo sapiens
  Payload ID: 4489
  Gene Symbol: CLASP2
  Gene Name: cytoplasmic linker associated protein 2
  Uniprot ID: O75122
  ENSP ID: ENSP00000352581
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGAGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22239 - protein, 1513 aa, Homo sapiens
  Payload ID: 4489
  Gene Symbol: CLASP2
  Gene Name: cytoplasmic linker associated protein 2
  ENSP ID: ENSP00000382297
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22240 - protein, 205 aa, Homo sapiens
  Payload ID: 4489
  Gene Symbol: CLASP2
  Gene Name: cytoplasmic linker associated protein 2
  ENSP ID: ENSP00000417386
  MOD_RES (1)..(1): Any amino acid
XKKMGADLLGSVQAKVQKALDVTRESFPNDLQFNILMRFTVDQTQTPSLKTVKPALRDQLHSFWSSKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDT

SEQ ID NO: 22241 - protein, 1293 aa, Homo sapiens
  Payload ID: 4489
  Gene Symbol: CLASP2
  Gene Name: cytoplasmic linker associated protein 2
  ENSP ID: ENSP00000417518
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22242 - protein, 178 aa, Homo sapiens
  Payload ID: 4489
  Gene Symbol: CLASP2
  Gene Name: cytoplasmic linker associated protein 2
  ENSP ID: ENSP00000417666
RSQGCSREASPSRLSVARSSRIPRPSVSQGCSREASRESSRDTSPVRSFQPLASRHHSRSTGALYAPEVYGASGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNW

SEQ ID NO: 22243 - protein, 178 aa, Homo sapiens
  Payload ID: 4489
  Gene Symbol: CLASP2
  Gene Name: cytoplasmic linker associated protein 2
  ENSP ID: ENSP00000418411
MAMGDDKSFDDEESVDGNRPSSAASAFKVPAPKTSGNPANSARKPGSAGGPKVGAGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEA

SEQ ID NO: 22244 - protein, 184 aa, Homo sapiens
  Payload ID: 4489
  Gene Symbol: CLASP2
  Gene Name: cytoplasmic linker associated protein 2
  ENSP ID: ENSP00000418488
  MOD_RES (1)..(1): Any amino acid
XGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVDTQ

SEQ ID NO: 22245 - protein, 454 aa, Homo sapiens
  Payload ID: 4489
  Gene Symbol: CLASP2
  Gene Name: cytoplasmic linker associated protein 2
  ENSP ID: ENSP00000418939
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGKRTDYGKLYHVLSLISVKTSSYTLIISIHSCYLRIVHMF

SEQ ID NO: 22246 - protein, 233 aa, Homo sapiens
  Payload ID: 4489
  Gene Symbol: CLASP2
  Gene Name: cytoplasmic linker associated protein 2
  ENSP ID: ENSP00000418945
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVP

SEQ ID NO: 22247 - protein, 1273 aa, Homo sapiens
  Payload ID: 4489
  Gene Symbol: CLASP2
  Gene Name: cytoplasmic linker associated protein 2
  ENSP ID: ENSP00000419305
MAMGDDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKRVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22248 - protein, 1514 aa, Homo sapiens
  Payload ID: 4489
  Gene Symbol: CLASP2
  Gene Name: cytoplasmic linker associated protein 2
  ENSP ID: ENSP00000419974
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGAGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22249 - protein, 220 aa, Homo sapiens
  Payload ID: 4489
  Gene Symbol: CLASP2
  Gene Name: cytoplasmic linker associated protein 2
  ENSP ID: ENSP00000420307
  MOD_RES (1)..(1): Any amino acid
XSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEGYDNSESSVRKACVFCLVAVHAVIGDELKPHLSQLTGSKMKLLNLYIKRAQTGSGGADPTTDVSGQS

SEQ ID NO: 22250 - protein, 1304 aa, Homo sapiens
  Payload ID: 4489
  Gene Symbol: CLASP2
  Gene Name: cytoplasmic linker associated protein 2
  ENSP ID: ENSP00000489023
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQRSSSPDKNEGSQSANTIGAGSRSGSPGRVLTTTALSTVSSGVQRVLVNSASAQKRSKIPRSQGCSREASPSRLSVARSSRIPRPSVSQGCSREASRESSRDTSPVRSFQPLGPGYGISQSSRLSSSVSAMRVLNTGSDVEEAVADALLLGDIRTKKKPARRRYESYGMHSDDDANSDASSACSERSYSSRNGSIPTYMRQTEDVAEVLNRCASSNWSERKEGLLGLQNLLKNQRTLSRVELKRLCEIFTRMFADPHGKVFSMFLETLVDFIQVHKDDLQDWLFVLLTQLLKKMGADLLGSVQAKVQKALDVTRESFPNDLQFNILMRFTVDQTQTPSLKVKVAILKYIETLAKQMDPGDFINSSETRLAVSRVITWTTEPKSSDVRKAAQSVLISLFELNTPEFTMLLGALPKTFQDGATKLLHNHLRNTGNGTQSSMGSPLTRPTPRSPANWSSPLTSPTNTSQNTLSPSAFDYDTENMNSEDIYSSLRGVTEAIQNFSFRSQEDMNEPLKRDSKKDDGDSMCGGPGMSDPRAGGDATDSSQTALDNKASLLHSMPTHSSPRSRDYNPYNYSDSISPFNKSALKEAMFDDDADQFPDDLSLDHSDLVAELLKELSNHNERVEERKIALYELMKLTQEESFSVWDEHFKTILLLLLETLGDKEPTIRALALKVLREILRHQPARFKNYAELTVMKTLEAHKDPHKEVVRSAEEAASVLATSISPEQCIKVLCPIIQTADYPINLAAIKMQTKVIERVSKETLNLLLPEIMPGLIQGYDNSESSVRKACVFCLVAVHAVIGDELKPHLSQLTGSKMKLLNLYIKRAQTGSGGADPTTDVSGQS

SEQ ID NO: 22251 - protein, 114 aa, Homo sapiens
  Payload ID: 4490
  Gene Symbol: CPEB1
  Gene Name: cytoplasmic polyadenylation element binding protein 1
  ENSP ID: ENSP00000455044
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTS

SEQ ID NO: 22252 - protein, 35 aa, Homo sapiens
  Payload ID: 4490
  Gene Symbol: CPEB1
  Gene Name: cytoplasmic polyadenylation element binding protein 1
  ENSP ID: ENSP00000455268
MLFPTSAQESSRGLPDANDLCLGLQSLSLTGWDRP

SEQ ID NO: 22253 - protein, 17 aa, Homo sapiens
  Payload ID: 4490
  Gene Symbol: CPEB1
  Gene Name: cytoplasmic polyadenylation element binding protein 1
  ENSP ID: ENSP00000457137
MLFPTSAQESSRGLPDA

SEQ ID NO: 22254 - protein, 486 aa, Homo sapiens
  Payload ID: 4490
  Gene Symbol: CPEB1
  Gene Name: cytoplasmic polyadenylation element binding protein 1
  Uniprot ID: Q9BZB8
  ENSP ID: ENSP00000477557
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22255 - protein, 561 aa, Homo sapiens
  Payload ID: 4490
  Gene Symbol: CPEB1
  Gene Name: cytoplasmic polyadenylation element binding protein 1
  Uniprot ID: Q9BZB8
  ENSP ID: ENSP00000477715
MAFPLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22256 - protein, 561 aa, Homo sapiens
  Payload ID: 4490
  Gene Symbol: CPEB1
  Gene Name: cytoplasmic polyadenylation element binding protein 1
  ENSP ID: ENSP00000478378
MALSLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22257 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000478558

SEQ ID NO: 22258 - protein, 626 aa, Homo sapiens
  Payload ID: 4490
  Gene Symbol: CPEB1
  Gene Name: cytoplasmic polyadenylation element binding protein 1
  ENSP ID: ENSP00000478598
MSWKSSLPTFFCHIYSFFHDFLYWLCGKSVKSCTTSGNSFFKQEFIILGMMAFMDFSVTMMALSLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22259 - protein, 138 aa, Homo sapiens
  Payload ID: 4490
  Gene Symbol: CPEB1
  Gene Name: cytoplasmic polyadenylation element binding protein 1
  ENSP ID: ENSP00000478841
MLFPTSAQESSRGLPDANDLCLGLQSLSLTGWDRPWSTQDSDSSAQSSTHSVKPSHFSTSALPVSVRGWSQRPFKDGGRVSDGPRASCSCCSHSLPNQCFKEMARSFCVAILGPPRSSQRPLQHRERGQAAPTSCSCE

SEQ ID NO: 22260 - protein, 564 aa, Homo sapiens
  Payload ID: 4490
  Gene Symbol: CPEB1
  Gene Name: cytoplasmic polyadenylation element binding protein 1
  ENSP ID: ENSP00000479625
MPECLWTQGVLQEVLNSYFCGSIILSTLPWEVPGGHASRICLLLLATGENKQVECYQLSPGLSSLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22261 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000481009

SEQ ID NO: 22262 - protein, 588 aa, Homo sapiens
  Payload ID: 4490
  Gene Symbol: CPEB1
  Gene Name: cytoplasmic polyadenylation element binding protein 1
  ENSP ID: ENSP00000481010
MFSGIATSTSSSMSGTGLEHSSLSDCLLLIPLEEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22263 - protein, 491 aa, Homo sapiens
  Payload ID: 4490
  Gene Symbol: CPEB1
  Gene Name: cytoplasmic polyadenylation element binding protein 1
  Uniprot ID: Q9BZB8
  ENSP ID: ENSP00000482116
MLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGNMPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22264 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000482965

SEQ ID NO: 22265 - protein, 491 aa, Homo sapiens; identical to SEQ ID NO: 22263
  Payload ID: 4490
  Gene Symbol: CPEB1
  Gene Name: cytoplasmic polyadenylation element binding protein 1
  Uniprot ID: Q9BZB8
  ENSP ID: ENSP00000483590

SEQ ID NO: 22266 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000483857

SEQ ID NO: 22267 - protein, 561 aa, Homo sapiens; identical to SEQ ID NO: 22256
  Payload ID: 4490
  Gene Symbol: CPEB1
  Gene Name: cytoplasmic polyadenylation element binding protein 1
  ENSP ID: ENSP00000483951

SEQ ID NO: 22268 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000484549

SEQ ID NO: 22269 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000487757

SEQ ID NO: 22270 - protein, 17 aa, Homo sapiens
  Payload ID: 4490
  Gene Symbol: CPEB1
  Gene Name: cytoplasmic polyadenylation element binding protein 1
  ENSP ID: ENSP00000487897
MLFPTSAQESSRGLPDA

SEQ ID NO: 22271 - protein, 626 aa, Homo sapiens; identical to SEQ ID NO: 22258
  Payload ID: 4490
  Gene Symbol: CPEB1
  Gene Name: cytoplasmic polyadenylation element binding protein 1
  ENSP ID: ENSP00000488102

SEQ ID NO: 22272 - protein, 138 aa, Homo sapiens
  Payload ID: 4490
  Gene Symbol: CPEB1
  Gene Name: cytoplasmic polyadenylation element binding protein 1
  ENSP ID: ENSP00000488206
MLFPTSAQESSRGLPDANDLCLGLQSLSLTGWDRPWSTQDSDSSAQSSTHSVKPSHFSTSALPVSVRGWSQRPFKDGGRVSDGPRASCSCCSHSLPNQCFKEMARSFCVAVLGPPRSSQRPLQHRERGQAAPTSCSCE

SEQ ID NO: 22273 - protein, 486 aa, Homo sapiens; identical to SEQ ID NO: 22254
  Payload ID: 4490
  Gene Symbol: CPEB1
  Gene Name: cytoplasmic polyadenylation element binding protein 1
  Uniprot ID: Q9BZB8
  ENSP ID: ENSP00000488352

SEQ ID NO: 22274 - protein, 556 aa, Homo sapiens
  Payload ID: 4490
  Gene Symbol: CPEB1
  Gene Name: cytoplasmic polyadenylation element binding protein 1
  ENSP ID: ENSP00000488484
EEEAGRIKDCWDNQEAPALSTCSNANIFRRINAILDNSLDFSRVCTTPINRGIHDHLPDFQDSEETVTSRMLFPTSAQESSRGLPDANDLCLGLQSLSLTGWDRPWSTQDSDSSAQSSTHSVLSMLHNPLGNVLGKPPLSFLPLDPLGSDLVDKFPAPSVRGSRLDTRPILDSRSSSPSDSDTSGFSSGSDHLSDLISSLRISPPLPFLSLSGGGPRDPLKMGVGSRMDQEQAALAAVTPSPTSASKRWPGASVWPSWDLLEAPKDPFSIEREARLHRQAAAVNEATCTWSGQLPPRNYKNPIYSCKVFLGGVPWDITEAGLVNTFRVFGSLSVEWPGKDGKHPRCPPKGYVYLVFELEKSVRSLLQACSHDPLSPDGLSEYYFKMSSRRMRCKEVQVIPWVLADSNFVRSPSQRLDPSRTVFVGALHGMLNAEALAAILNDLFGGVVYAGIDTDKHKYPIGSGRVTFNNQRSYLKAVSAAFVEIKTTKFTKKVQIDPYLEDSLCHICSSQPGPFFCRDQVCFKYFCRSCWHWRHSMEGLRHHSPLMRNQKNRDSS

SEQ ID NO: 22275 - protein, 35 aa, Homo sapiens; identical to SEQ ID NO: 22252
  Payload ID: 4490
  Gene Symbol: CPEB1
  Gene Name: cytoplasmic polyadenylation element binding protein 1
  ENSP ID: ENSP00000488508

SEQ ID NO: 22276 - protein, 114 aa, Homo sapiens; identical to SEQ ID NO: 22251
  Payload ID: 4490
  Gene Symbol: CPEB1
  Gene Name: cytoplasmic polyadenylation element binding protein 1
  ENSP ID: ENSP00000488628

SEQ ID NO: 22277 - protein, 564 aa, Homo sapiens; identical to SEQ ID NO: 22260
  Payload ID: 4490
  Gene Symbol: CPEB1
  Gene Name: cytoplasmic polyadenylation element binding protein 1
  ENSP ID: ENSP00000488842

SEQ ID NO: 22278 - protein, 597 aa, Homo sapiens; identical to SEQ ID NO: 20124
  Payload ID: 4491
  Gene Symbol: CPEB2
  Gene Name: cytoplasmic polyadenylation element binding protein 2
  ENSP ID: ENSP00000259997

SEQ ID NO: 22279 - protein, 559 aa, Homo sapiens; identical to SEQ ID NO: 20119
  Payload ID: 4491
  Gene Symbol: CPEB2
  Gene Name: cytoplasmic polyadenylation element binding protein 2
  Uniprot ID: Q7Z5Q1
  ENSP ID: ENSP00000334058

SEQ ID NO: 22280 - protein, 567 aa, Homo sapiens; identical to SEQ ID NO: 20122
  Payload ID: 4491
  Gene Symbol: CPEB2
  Gene Name: cytoplasmic polyadenylation element binding protein 2
  Uniprot ID: Q7Z5Q1
  ENSP ID: ENSP00000371832

SEQ ID NO: 22281 - protein, 562 aa, Homo sapiens; identical to SEQ ID NO: 20121
  Payload ID: 4491
  Gene Symbol: CPEB2
  Gene Name: cytoplasmic polyadenylation element binding protein 2
  Uniprot ID: Q7Z5Q1
  ENSP ID: ENSP00000371838

SEQ ID NO: 22282 - protein, 1007 aa, Homo sapiens; identical to SEQ ID NO: 20120
  Payload ID: 4491
  Gene Symbol: CPEB2
  Gene Name: cytoplasmic polyadenylation element binding protein 2
  Uniprot ID: Q7Z5Q1
  ENSP ID: ENSP00000414270

SEQ ID NO: 22283 - protein, 167 aa, Homo sapiens; identical to SEQ ID NO: 20118
  Payload ID: 4491
  Gene Symbol: CPEB2
  Gene Name: cytoplasmic polyadenylation element binding protein 2
  ENSP ID: ENSP00000423890

SEQ ID NO: 22284 - protein, 589 aa, Homo sapiens; identical to SEQ ID NO: 20117
  Payload ID: 4491
  Gene Symbol: CPEB2
  Gene Name: cytoplasmic polyadenylation element binding protein 2
  Uniprot ID: Q7Z5Q1
  ENSP ID: ENSP00000424084

SEQ ID NO: 22285 - protein, 1034 aa, Homo sapiens; identical to SEQ ID NO: 20123
  Payload ID: 4491
  Gene Symbol: CPEB2
  Gene Name: cytoplasmic polyadenylation element binding protein 2
  Uniprot ID: Q7Z5Q1
  ENSP ID: ENSP00000443985

SEQ ID NO: 22286 - protein, 698 aa, Homo sapiens
  Payload ID: 4492
  Gene Symbol: CPEB3
  Gene Name: cytoplasmic polyadenylation element binding protein 3
  Uniprot ID: Q8NE35
  ENSP ID: ENSP00000265997
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGKHYPPSGPPMSFADIMWRNHFAGRMGINFHHPGTDNIMALNNAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 22287 - protein, 684 aa, Homo sapiens
  Payload ID: 4492
  Gene Symbol: CPEB3
  Gene Name: cytoplasmic polyadenylation element binding protein 3
  Uniprot ID: Q8NE35
  ENSP ID: ENSP00000398310
MQDDLLMDKSKTQPQPQQQQRQQQQPQPESSVSEAPSTPLSSETPKPEENSAVPALSPAAAPPAPNGPDKMQMESPLLPGLSFHQPPQQPPPPQEPAAPGASLSPSFGSTWSTGTTNAVEDSFFQGITPVNGTMLFQNFPHHVNPVFGGTFSPQIGLAQTQHHQQPPPPAPAPQPAQPAQPPQAQPPQQRRSPASPSQAPYAQRSAAAAYGHQPIMTSKPSSSSAVAAAAAAAAASSASSSWNTHQSVNAAWSAPSNPWGGLQAGRDPRRAVGVGVGVGVGVPSPLNPISPLKKPFSSNVIAPPKFPRAAPLTSKSWMEDNAFRTDNGNNLLPFQDRSRPYDTFNLHSLENSLMDMIRTDHEPLKGRMGINFHHPGTDNIMALNSRSSLFPFEDAFLDDSHGDQALSSGLSSPTRCQNGERVERYSRKVFVGGLPPDIDEDEITASFRRFGPLVVDWPHKAESKSYFPPKGYAFLLFQEESSVQALIDACLEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHNDIDKRVEVKPYVLDDQMCDECQGTRCGGKFAPFFCANVTCLQYYCEYCWASIHSRAGREFHKPLVKEGGDRPRHVPFRWS

SEQ ID NO: 22288 - protein, 698 aa, Homo sapiens; identical to SEQ ID NO: 22286
  Payload ID: 4492
  Gene Symbol: CPEB3
  Gene Name: cytoplasmic polyadenylation element binding protein 3
  Uniprot ID: Q8NE35
  ENSP ID: ENSP00000482128

SEQ ID NO: 22289 - protein, 729 aa, Homo sapiens
  Payload ID: 4493
  Gene Symbol: CPEB4
  Gene Name: cytoplasmic polyadenylation element binding protein 4
  Uniprot ID: Q17RY0
  ENSP ID: ENSP00000265085
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKGRLNYSYPGSDSSLLINARTYGRRRGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 22290 - protein, 712 aa, Homo sapiens
  Payload ID: 4493
  Gene Symbol: CPEB4
  Gene Name: cytoplasmic polyadenylation element binding protein 4
  Uniprot ID: Q17RY0
  ENSP ID: ENSP00000334533
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKARTYGRRRGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 22291 - protein, 322 aa, Homo sapiens
  Payload ID: 4493
  Gene Symbol: CPEB4
  Gene Name: cytoplasmic polyadenylation element binding protein 4
  Uniprot ID: Q17RY0
  ENSP ID: ENSP00000427990
MHSLESSLIDIMRAENDTIKGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 22292 - protein, 639 aa, Homo sapiens
  Payload ID: 4493
  Gene Symbol: CPEB4
  Gene Name: cytoplasmic polyadenylation element binding protein 4
  ENSP ID: ENSP00000429048
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVSLILHFGKF

SEQ ID NO: 22293 - protein, 704 aa, Homo sapiens
  Payload ID: 4493
  Gene Symbol: CPEB4
  Gene Name: cytoplasmic polyadenylation element binding protein 4
  ENSP ID: ENSP00000429092
MGDYGFGVLVQSNTGNKSAFPVRFHPHLQPPHHHQNATPSPAAFINNNTAANGSSAGSAWLFPAPATHNIQDEILGSEKAKSQQQEQQDPLEKQQLSPSPGQEAGILPETEKAKSEENQGDNSSENGNGKEKIRIESPVLTGFDYQEATGLGTSTQPLTSSASSLTGFSNWSAAIAPSSSTIINEDASFFHQGGVPAASANNGALLFQNFPHHVSPGFGGSFSPQIGPLSQHHPHHPHFQHHHSQHQQQRRSPASPHPPPFTHRNAAFNQLPHLANNLNKPPSPWSSYQSPSPTPSSSWSPGGGGYGGWGGSQGRDHRRGLNGGITPLNSISPLKKNFASNHIQLQKYARPSSAFAPKSWMEDSLNRADNIFPFPDRPRTFDMHSLESSLIDIMRAENDTIKGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 22294 - protein, 147 aa, Homo sapiens
  Payload ID: 4493
  Gene Symbol: CPEB4
  Gene Name: cytoplasmic polyadenylation element binding protein 4
  ENSP ID: ENSP00000429423
  MOD_RES (1)..(1): Any amino acid
XDHRRGLNGGITPLNSISPLKKNFASNHIQLQKYARPSSAFAPKSWMEDSLNRADNIFPFPDRPRTFDMHSLESSLIDIMRAENDTIKGRLNYSYPGSDSSLLINGQSSLFPMEDGFLDDGRGDQPLHSGLGSPHCFSHQNGERVER

SEQ ID NO: 22295 - protein, 339 aa, Homo sapiens
  Payload ID: 4493
  Gene Symbol: CPEB4
  Gene Name: cytoplasmic polyadenylation element binding protein 4
  ENSP ID: ENSP00000430345
MHSLESSLIDIMRAENDTIKGRLNYSYPGSDSSLLINGQSSLFPMEDGFLDDGRGDQPLHSGLGSPHCFSHQNGERVERYSRKVFVGGLPPDIDEDEITASFRRFGPLIVDWPHKAESKSYFPPKGYAFLLFQDESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGEIDKRVEVKPYVLDDQLCDECQGARCGGKFAPFFCANVTCLQYYCEYCWAAIHSRAGREFHKPLVKEGGDRPRHISFRWN

SEQ ID NO: 22296 - protein, 682 aa, Homo sapiens
  Payload ID: 4494
  Gene Symbol: CKAP2
  Gene Name: cytoskeleton associated protein 2
  Uniprot ID: Q8WWK9
  ENSP ID: ENSP00000258607
MSTPAVPQDLQLPPSQRAQSAFKEQRRQKLKEHLLRRKTLFAYKQENEMLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 22297 - protein, 494 aa, Homo sapiens
  Payload ID: 4494
  Gene Symbol: CKAP2
  Gene Name: cytoskeleton associated protein 2
  Uniprot ID: Q8WWK9
  ENSP ID: ENSP00000367273
MSTPAVPQDLQLPPSQRAQSAFKEQRRQKLKEHLLRRKTLFAYKQENEMLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQVR

SEQ ID NO: 22298 - protein, 683 aa, Homo sapiens
  Payload ID: 4494
  Gene Symbol: CKAP2
  Gene Name: cytoskeleton associated protein 2
  Uniprot ID: Q8WWK9
  ENSP ID: ENSP00000367276
MSTPAVPQDLQLPPSQRAQSAFKEQRRQKLKEHLLRRKTLFAYKQENEMLSSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 22299 - protein, 634 aa, Homo sapiens
  Payload ID: 4494
  Gene Symbol: CKAP2
  Gene Name: cytoskeleton associated protein 2
  Uniprot ID: Q8WWK9
  ENSP ID: ENSP00000417830
MLSSRDQRVVTSEDQVQEGTKVLKLKTKMADKENMKRPAESKNNTVVGKHCIPLKPSNELTNSTVVIDTHKPKDSNQTPHLLLTEDDPQSQHMTLSQAFHLKNNSKKKQMTTEKQKQDANMPKKPVLGSYRGQIVQSKINSFRKPLQVKDESSAATKKLSATIPKATKPQPVNTSSVTVKSNRSSNMTATTKFVSTTSQNTQLVRPPIRSHHSNTRDTVKQGISRTSANVTIRKGPHEKELLQSKTALSSVKTSSSQGIIRNKTLSRSIASEVIARPASLSNDKLMEKSEPVDQRRHTAGKAIVDSRSAQPKETSEERKARLSEWKAGKGRVLKRPPNSVVTQHEPAGQNEKPVGSFWTTMAEEDEQRLFTEKVNNTFSECLNLINEGCPKEDILVTLNDLIKNIPDAKKLVKYWICLALIEPITSPIENIIAIYEKAILAGAQPIEEMRHTIVDILTMKSQEKANLGENMEKSCASKEEVKEVSIEDTGVDVDPEKLEMESKLHRNLLFQDCEKEQDNKTKDPTHDVKTPNTETRTSCLIKYNVSTTPYLQSVKKKVQFDGTNSAFKELKFLTPVRRSRRLQEKTSKLPDMLKDHYPCVSSLEQLTELGRETDAFVCRPNAALCRVYYEADTT

SEQ ID NO: 22300 - protein, 97 aa, Homo sapiens
  Payload ID: 4494
  Gene Symbol: CKAP2
  Gene Name: cytoskeleton associated protein 2
  ENSP ID: ENSP00000418224
MLSSSRDQRVVTSEDQVQEGTKVLKLKTKMADKENMKRPAESKNNTVVGKHCIPLKPSNELTNSTVVIDTHKPKDSNQTPHLLLTEDDPQSQHMTLS

SEQ ID NO: 22301 - protein, 93 aa, Homo sapiens
  Payload ID: 4494
  Gene Symbol: CKAP2
  Gene Name: cytoskeleton associated protein 2
  ENSP ID: ENSP00000418431
MKRPAESKNNTVVGKHCIPLKPSNELTNSTVVIDTHKPKDSNQTPHLLLTEDDPQSQHMTLSQAFHLKNNSKKKQMTTEKQKQDANMPKKPVL

SEQ ID NO: 22302 - protein, 745 aa, Homo sapiens
  Payload ID: 4495
  Gene Symbol: CKAP2L
  Gene Name: cytoskeleton associated protein 2-like
  Uniprot ID: Q8IYA6
  ENSP ID: ENSP00000305204
MVGPGPTAAAAVEERQRKLQEYLAAKGKLKSQNTKPYLKSKNNCQNQPPSKSTIRPKNDVTNHVVLPVKPKRSISIKLQPRPPNTAGSQKPKLEPPKLLGKRLTSECVSSNPYSKPSSKSFQQCEAGSSTTGELSRKPVGSLNIEQLKTTKQQLTDQGNGKCIDFMNNIHVENESLDNFLKETNKENLLDILTEPERKPDPKLYTRSKPKTDSYNQTKNSLVPKQALGKSSVNSAVLKDRVNKQFVGETQSRTFPVKSQQLSRGADLARPGVKPSRTVPSHFIRTLSKVQSSKKPVVKNIKDIKVNRSQYERPNETKIRSYPVTEQRVKHTKPRTYPSLLQGEYNNRHPNIKQDQKSSQVCIPQTSCVLQKSKAISQRPNLTVGRFNSAIPSTPSIRPNGTSGNKHNNNGFQQKAQTLDSKLKKAVPQNHFLNKTAPKTQADVTTVNGTQTNPNIKKKATAEDRRKQLEEWQKSKGKTYKRPPMELKTKRKVIKEMNISFWKSIEKEEEEKKAQLELSSKINNTLTECLNLIEGGVPSNEILNILSSIPEAEKFAKFWICKAKLLASKGTFDVIGLYEEAIKNGATPIQELRKVVLNILQDSNRTTEGITSDSLVAETSITSVEELAKKMESVKSCLSPKEREQVTATPRIAKAEQHNYPGIKLQIGPIPRINGMPEVQDMKFITPVRRSSRIERAVSRYPEMLQEHDLVVASLDELLEVEETKCFIFRRNEALPVTLGFQTPES

SEQ ID NO: 22303 - protein, 188 aa, Homo sapiens
  Payload ID: 4495
  Gene Symbol: CKAP2L
  Gene Name: cytoskeleton associated protein 2-like
  ENSP ID: ENSP00000414834
MVGPGPTAAAAVEERQRKLQEYLAAKGKLKSQNTKPYLKSKNNCQNQPPSKSTIRPKNDVTNHVVLPVKPKRSISIKLQPRPPNTAGSQKPKLEPPKLLGKRLTSECVSSNPYSKPSSKSFQQCEAGSSTTGELSRKPVGSLNIEQLKTTKQQLTDQGNAKSTDFGLQVEKGCSPEPFSEQDSSQNSS

SEQ ID NO: 22304 - protein, 1972 aa, Homo sapiens
  Payload ID: 4496
  Gene Symbol: CKAP5
  Gene Name: cytoskeleton associated protein 5
  Uniprot ID: Q14008
  ENSP ID: ENSP00000310227
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVNPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 22305 - protein, 1972 aa, Homo sapiens; identical to SEQ ID NO: 22304
  Payload ID: 4496
  Gene Symbol: CKAP5
  Gene Name: cytoskeleton associated protein 5
  Uniprot ID: Q14008
  ENSP ID: ENSP00000346566

SEQ ID NO: 22306 - protein, 166 aa, Homo sapiens
  Payload ID: 4496
  Gene Symbol: CKAP5
  Gene Name: cytoskeleton associated protein 5
  ENSP ID: ENSP00000431509
  MOD_RES (1)..(1): Any amino acid
XRKGPAEDMSSKLKIMYRTYRIQARSMSGHPEAAQMVRREFQLDLDEIENDNGTVRCEMPELVQHKLDDIFEPVLIPEPKIRAVSPHFDDMHSNTASTINFIISQVASGDINTSIQALTQLRLIYNTHMADEKLEKDEIIKLYSCIIGNMISLFQIESLAREASTG

SEQ ID NO: 22307 - protein, 2032 aa, Homo sapiens
  Payload ID: 4496
  Gene Symbol: CKAP5
  Gene Name: cytoskeleton associated protein 5
  Uniprot ID: Q14008
  ENSP ID: ENSP00000432768
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVNPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 22308 - protein, 203 aa, Homo sapiens
  Payload ID: 4496
  Gene Symbol: CKAP5
  Gene Name: cytoskeleton associated protein 5
  ENSP ID: ENSP00000434523
  MOD_RES (1)..(1): Any amino acid
XLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKVLLLFFCAVQGG

SEQ ID NO: 22309 - protein, 190 aa, Homo sapiens
  Payload ID: 4496
  Gene Symbol: CKAP5
  Gene Name: cytoskeleton associated protein 5
  ENSP ID: ENSP00000436052
ISSNANMLRKGPAEDMSSKLKIMYRTYRIQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQ

SEQ ID NO: 22310 - protein, 151 aa, Homo sapiens
  Payload ID: 4496
  Gene Symbol: CKAP5
  Gene Name: cytoskeleton associated protein 5
  ENSP ID: ENSP00000436769
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKA

SEQ ID NO: 22311 - protein, 602 aa, Homo sapiens
  Payload ID: 4497
  Gene Symbol: CKAP4
  Gene Name: cytoskeleton-associated protein 4
  Uniprot ID: Q07065
  ENSP ID: ENSP00000367265
MPSAKQRGSKGGHGAASPSEKGAHPSGGADDVAKKPPPAPQQPPPPPAPHPQQHPQQHPQNQAHGKGGHRGGGGGGGKSSSSSSASAAAAAAAASSSASCSRRLGRALNFLFYLALVAAAAFSGWCVHHVLEEVQQVRRSHQDFSRQREELGQGLQGVEQKVQSLQATFGTFESILRSSQHKQDLTEKAVKQGESEVSRISEVLQKLQNEILKDLSDGIHVVKDARERDFTSLENTVEERLTELTKSINDNIAIFTEVQKRSQKEINDMKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 22312 - protein, 26 aa, Homo sapiens
  Payload ID: 4497
  Gene Symbol: CKAP4
  Gene Name: cytoskeleton-associated protein 4
  ENSP ID: ENSP00000449240
MPAGGGPRSLWPVKFWLVQSLQATFG

SEQ ID NO: 22313 - protein, 339 aa, Homo sapiens
  Payload ID: 4498
  Gene Symbol: CIAO1
  Gene Name: cytosolic iron-sulfur assembly component 1
  Uniprot ID: O76071
  ENSP ID: ENSP00000418287
MKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 22314 - protein, 348 aa, Homo sapiens
  Payload ID: 4499
  Gene Symbol: CTU1
  Gene Name: cytosolic thiouridylase subunit 1
  Uniprot ID: Q7Z7A3
  ENSP ID: ENSP00000390011
MPAPPCASCHAARAALRRPLSGQALCGACFCAAFEAEVLHTVLAGRLLPPGAVVAVGASGGKDSTVLAHVLRALAPRLGISLQLVAVDEGIGGYRDAALAAVRRQAARWELPLTVVAYEDLFGGWTMDAVARSTAGSGRSRSCCTFCGVLRRRALEEGARRVGATHIVTGHNADDMAETVLMNFLRGDAGRLARGGGLGSPGEGGALPRCRPLQFASQKEVVLYAHFRRLDYFSEECVYAPEAFRGHARDLLKRLEAARPSAVLDLVHSAERLALAPAARPPRPGACSRCGALASRALCQACALLDGLNRGRPRLAIGKGRRGLDEEATPGTPGDPARPPASKAVPTF

SEQ ID NO: 22315 - protein, 485 aa, Homo sapiens
  Payload ID: 4500
  Gene Symbol: CTU2
  Gene Name: cytosolic thiouridylase subunit 2 homolog (S. pombe)
  Uniprot ID: Q2VPK5
  ENSP ID: ENSP00000308617
MCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLGLGLAGDPGLSD

SEQ ID NO: 22316 - protein, 515 aa, Homo sapiens
  Payload ID: 4500
  Gene Symbol: CTU2
  Gene Name: cytosolic thiouridylase subunit 2 homolog (S. pombe)
  Uniprot ID: Q2VPK5
  ENSP ID: ENSP00000388320
MCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 22317 - protein, 69 aa, Homo sapiens
  Payload ID: 4500
  Gene Symbol: CTU2
  Gene Name: cytosolic thiouridylase subunit 2 homolog (S. pombe)
  ENSP ID: ENSP00000454923
MCQVGEDYGEPAPEEPPPAPRPSREQKCVKCKEAQPVVVIRAGDAFCRCSWRGLGGLRPAPWSGRFLRA

SEQ ID NO: 22318 - protein, 89 aa, Homo sapiens
  Payload ID: 4500
  Gene Symbol: CTU2
  Gene Name: cytosolic thiouridylase subunit 2 homolog (S. pombe)
  ENSP ID: ENSP00000455010
MLGKNRLIFPGEKVLLAWSGGPSSSSMVWQVLEGLSQDSAKRLRFVAGVIFVDEGAACGQSLEERSKTLAEVKPILQATGFPWHVVALE

SEQ ID NO: 22319 - protein, 108 aa, Homo sapiens
  Payload ID: 4500
  Gene Symbol: CTU2
  Gene Name: cytosolic thiouridylase subunit 2 homolog (S. pombe)
  ENSP ID: ENSP00000455305
CCSPGVGWAQRCGQGACRREDPQACIEEQLCYSCRVNMKDLPSLDPLPPYILAEAQLRTQRYWGPHCRGAWVRGLGAGAHCSFLSRAWGLQEIRDCLIEDSDDEAGQS

SEQ ID NO: 22320 - protein, 586 aa, Homo sapiens
  Payload ID: 4500
  Gene Symbol: CTU2
  Gene Name: cytosolic thiouridylase subunit 2 homolog (S. pombe)
  ENSP ID: ENSP00000456908
MCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDERTPGVLTVALRSAAREKPLPKGKWPTPHSSARKHRPAERGLEGFSQVEVALQPALPGSSLSPDSFCLGFSEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 22321 - protein, 393 aa, Homo sapiens
  Payload ID: 4501
  Gene Symbol: CRTAM
  Gene Name: cytotoxic and regulatory T cell molecule
  Uniprot ID: O95727
  ENSP ID: ENSP00000227348
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 22322 - protein, 194 aa, Homo sapiens
  Payload ID: 4501
  Gene Symbol: CRTAM
  Gene Name: cytotoxic and regulatory T cell molecule
  Uniprot ID: O95727
  ENSP ID: ENSP00000433728
MWVKLLSIVAEFCFSPFLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 22323 - protein, 174 aa, Homo sapiens
  Payload ID: 4502
  Gene Symbol: CTLA4
  Gene Name: cytotoxic T-lymphocyte-associated protein 4
  Uniprot ID: P16410
  ENSP ID: ENSP00000295854
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 22324 - protein, 223 aa, Homo sapiens
  Payload ID: 4502
  Gene Symbol: CTLA4
  Gene Name: cytotoxic T-lymphocyte-associated protein 4
  Uniprot ID: P16410
  ENSP ID: ENSP00000303939
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 22325 - protein, 137 aa, Homo sapiens
  Payload ID: 4502
  Gene Symbol: CTLA4
  Gene Name: cytotoxic T-lymphocyte-associated protein 4
  ENSP ID: ENSP00000409707
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 22326 - protein, 79 aa, Homo sapiens
  Payload ID: 4502
  Gene Symbol: CTLA4
  Gene Name: cytotoxic T-lymphocyte-associated protein 4
  Uniprot ID: P16410
  ENSP ID: ENSP00000417779
MACLGFQRHKAQLNLATRTWPCTLLFFLLFIPVFCKAMHVAQPAVVLASSRGIASFVSKEKKPSYNRGLCENAPNRARM

SEQ ID NO: 22327 - protein, 325 aa, Homo sapiens
  Payload ID: 4503
  Gene Symbol: DBP
  Gene Name: D site of albumin promoter (albumin D-box) binding protein
  Uniprot ID: Q10586
  ENSP ID: ENSP00000222122
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 22328 - protein, 262 aa, Homo sapiens
  Payload ID: 4503
  Gene Symbol: DBP
  Gene Name: D site of albumin promoter (albumin D-box) binding protein
  ENSP ID: ENSP00000469291
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKVSRAGCGR

SEQ ID NO: 22329 - protein, 123 aa, Homo sapiens
  Payload ID: 4503
  Gene Symbol: DBP
  Gene Name: D site of albumin promoter (albumin D-box) binding protein
  ENSP ID: ENSP00000469426
MTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 22330 - protein, 123 aa, Homo sapiens; identical to SEQ ID NO: 22329
  Payload ID: 4503
  Gene Symbol: DBP
  Gene Name: D site of albumin promoter (albumin D-box) binding protein
  ENSP ID: ENSP00000471220

SEQ ID NO: 22331 - protein, 521 aa, Homo sapiens
  Payload ID: 4504
  Gene Symbol: D2HGDH
  Gene Name: D-2-hydroxyglutarate dehydrogenase
  Uniprot ID: Q8N465
  ENSP ID: ENSP00000315351
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 22332 - protein, 320 aa, Homo sapiens
  Payload ID: 4504
  Gene Symbol: D2HGDH
  Gene Name: D-2-hydroxyglutarate dehydrogenase
  ENSP ID: ENSP00000383580
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLDAVGPEGKDHRGAEPGWLRVQVRPLPPCGAALRHRD

SEQ ID NO: 22333 - protein, 387 aa, Homo sapiens
  Payload ID: 4504
  Gene Symbol: D2HGDH
  Gene Name: D-2-hydroxyglutarate dehydrogenase
  ENSP ID: ENSP00000384723
MVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 22334 - protein, 318 aa, Homo sapiens
  Payload ID: 4504
  Gene Symbol: D2HGDH
  Gene Name: D-2-hydroxyglutarate dehydrogenase
  ENSP ID: ENSP00000387479
  MOD_RES (1)..(1): Any amino acid
XSHANHRPICLSPRIWPGSASATSTVCSSSESFLPRGPPAVSLLLHGPPTVSFPPPWPTHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPS

SEQ ID NO: 22335 - protein, 152 aa, Homo sapiens
  Payload ID: 4504
  Gene Symbol: D2HGDH
  Gene Name: D-2-hydroxyglutarate dehydrogenase
  ENSP ID: ENSP00000392602
  MOD_RES (1)..(1): Any amino acid
XHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGFLCSALIPLQLQSPVCRPPVVLGAR

SEQ ID NO: 22336 - protein, 189 aa, Homo sapiens
  Payload ID: 4504
  Gene Symbol: D2HGDH
  Gene Name: D-2-hydroxyglutarate dehydrogenase
  ENSP ID: ENSP00000395837
  MOD_RES (1)..(1): Any amino acid
XSVFCSDPTPTAVTCVPPACGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHL

SEQ ID NO: 22337 - protein, 243 aa, Homo sapiens
  Payload ID: 4504
  Gene Symbol: D2HGDH
  Gene Name: D-2-hydroxyglutarate dehydrogenase
  ENSP ID: ENSP00000400212
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGGLRPGGAEPVCGGTGLHHAAGLRSQGQLPHRGKRGNQRWRPAVSSIWLTAWDCPGPGSGAGRRHCPGLPDLPEEGQHGL

SEQ ID NO: 22338 - protein, 78 aa, Homo sapiens
  Payload ID: 4504
  Gene Symbol: D2HGDH
  Gene Name: D-2-hydroxyglutarate dehydrogenase
  ENSP ID: ENSP00000404596
GNTGMVGGSVPVFDEIILSTARMNRVLSFHSVSESPFYVLIETSGSNAGHDAEKLGHFLEHALGSGLVTDGTMATDQR

SEQ ID NO: 22339 - protein, 89 aa, Homo sapiens
  Payload ID: 4504
  Gene Symbol: D2HGDH
  Gene Name: D-2-hydroxyglutarate dehydrogenase
  ENSP ID: ENSP00000412511
RHCHERNLAVNPQGGNTGMVGGSVPVFDEIILSTARMNRVLSFHSVSGCPGFAEVLQTFSTCKGMLGEILSAFEFMDAVCMQLVGRHLH

SEQ ID NO: 22340 - protein, 202 aa, Homo sapiens
  Payload ID: 4504
  Gene Symbol: D2HGDH
  Gene Name: D-2-hydroxyglutarate dehydrogenase
  ENSP ID: ENSP00000481906
MSFPPLWPTRHVPASHPTCPLSCLGPCCPHCLCDSAPPSLPCPTLVQGASRPILILRAFPGPCHSVPCHDLKLQVGASPFRHGCPPSVRCPSRLIAGVPGCSVLSWSLGHSLSGIDSRVGATPGLGHSLSWVRAPPGLGHSLSGVGATPGLGHLLSGVGASPGEDTEHAAALTPCGVPPVPGCRSHSQPLSHLVSSSRCCGP

SEQ ID NO: 22341 - protein, 414 aa, Homo sapiens
  Payload ID: 4505
  Gene Symbol: DPF1
  Gene Name: D4, zinc and double PHD fingers family 1
  Uniprot ID: Q92782
  ENSP ID: ENSP00000347716
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 22342 - protein, 398 aa, Homo sapiens
  Payload ID: 4505
  Gene Symbol: DPF1
  Gene Name: D4, zinc and double PHD fingers family 1
  ENSP ID: ENSP00000390223
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 22343 - protein, 332 aa, Homo sapiens
  Payload ID: 4505
  Gene Symbol: DPF1
  Gene Name: D4, zinc and double PHD fingers family 1
  Uniprot ID: Q92782
  ENSP ID: ENSP00000391884
MEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 22344 - protein, 380 aa, Homo sapiens
  Payload ID: 4505
  Gene Symbol: DPF1
  Gene Name: D4, zinc and double PHD fingers family 1
  Uniprot ID: Q92782
  ENSP ID: ENSP00000397354
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 22345 - protein, 98 aa, Homo sapiens
  Payload ID: 4505
  Gene Symbol: DPF1
  Gene Name: D4, zinc and double PHD fingers family 1
  ENSP ID: ENSP00000399015
MEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDL

SEQ ID NO: 22346 - protein, 100 aa, Homo sapiens
  Payload ID: 4505
  Gene Symbol: DPF1
  Gene Name: D4, zinc and double PHD fingers family 1
  ENSP ID: ENSP00000408201
MATAIQNPLKSRGLLPRGHRALPQLQRAPVRRAQPATALPRLADRRGPEQLLHLDGEDPPRAGFGPGTDLHVPRPLLEEETETQHPGGPQTQALRVQDRL

SEQ ID NO: 22347 - protein, 388 aa, Homo sapiens
  Payload ID: 4505
  Gene Symbol: DPF1
  Gene Name: D4, zinc and double PHD fingers family 1
  ENSP ID: ENSP00000411569
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 22348 - protein, 332 aa, Homo sapiens; identical to SEQ ID NO: 22343
  Payload ID: 4505
  Gene Symbol: DPF1
  Gene Name: D4, zinc and double PHD fingers family 1
  Uniprot ID: Q92782
  ENSP ID: ENSP00000412098

SEQ ID NO: 22349 - protein, 210 aa, Homo sapiens
  Payload ID: 4505
  Gene Symbol: DPF1
  Gene Name: D4, zinc and double PHD fingers family 1
  ENSP ID: ENSP00000416347
MEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPD

SEQ ID NO: 22350 - protein, 54 aa, Homo sapiens
  Payload ID: 4505
  Gene Symbol: DPF1
  Gene Name: D4, zinc and double PHD fingers family 1
  ENSP ID: ENSP00000465123
MEKTHRGPGLAPGQIYTYPARCWRKKRRLNILEDPRLRPCEYKIDCEAPLKKEG

SEQ ID NO: 22351 - protein, 397 aa, Homo sapiens
  Payload ID: 4505
  Gene Symbol: DPF1
  Gene Name: D4, zinc and double PHD fingers family 1
  ENSP ID: ENSP00000483226
MATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 22352 - protein, 405 aa, Homo sapiens
  Payload ID: 4506
  Gene Symbol: DPF2
  Gene Name: D4, zinc and double PHD fingers family 2
  ENSP ID: ENSP00000252268
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDNSFKQKHTSKAPQRVCGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 22353 - protein, 207 aa, Homo sapiens
  Payload ID: 4506
  Gene Symbol: DPF2
  Gene Name: D4, zinc and double PHD fingers family 2
  Uniprot ID: Q92785
  ENSP ID: ENSP00000399714
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKDQLLFCDDCDRGYHMYCLTPSMSEPPEGSWSCHLCLDLLKEKASIYQNQNSS

SEQ ID NO: 22354 - protein, 106 aa, Homo sapiens
  Payload ID: 4506
  Gene Symbol: DPF2
  Gene Name: D4, zinc and double PHD fingers family 2
  ENSP ID: ENSP00000434885
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPADPRTR

SEQ ID NO: 22355 - protein, 116 aa, Homo sapiens
  Payload ID: 4506
  Gene Symbol: DPF2
  Gene Name: D4, zinc and double PHD fingers family 2
  ENSP ID: ENSP00000435887
ARTRKTLNHPLLFPRGLRSRNPKRVLMDWPCPTTTVTSAWGTQRLTRRRDNPRSWCPVLTVAAQDQLLFCDDCDRGYHMYCLTPSMSEPPEGSWSCHLCLDLLKEKASIYQNQNSS

SEQ ID NO: 22356 - protein, 391 aa, Homo sapiens
  Payload ID: 4506
  Gene Symbol: DPF2
  Gene Name: D4, zinc and double PHD fingers family 2
  Uniprot ID: Q92785
  ENSP ID: ENSP00000436901
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 22357 - protein, 357 aa, Homo sapiens
  Payload ID: 4507
  Gene Symbol: DPF3
  Gene Name: D4, zinc and double PHD fingers, family 3
  Uniprot ID: Q92784
  ENSP ID: ENSP00000370614
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 22358 - protein, 412 aa, Homo sapiens
  Payload ID: 4507
  Gene Symbol: DPF3
  Gene Name: D4, zinc and double PHD fingers, family 3
  ENSP ID: ENSP00000381791
MFYGRINGRNFAASSLPVAFAATPLMLFLPNPQLIFSFPISSRNHITGLMPPGKLKLENLFHMCTRLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 22359 - protein, 357 aa, Homo sapiens; identical to SEQ ID NO: 22357
  Payload ID: 4507
  Gene Symbol: DPF3
  Gene Name: D4, zinc and double PHD fingers, family 3
  Uniprot ID: Q92784
  ENSP ID: ENSP00000441640

SEQ ID NO: 22360 - protein, 367 aa, Homo sapiens
  Payload ID: 4507
  Gene Symbol: DPF3
  Gene Name: D4, zinc and double PHD fingers, family 3
  Uniprot ID: Q92784
  ENSP ID: ENSP00000444662
MGFTDLEEPISGCPGGPWALGLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 22361 - protein, 378 aa, Homo sapiens
  Payload ID: 4507
  Gene Symbol: DPF3
  Gene Name: D4, zinc and double PHD fingers, family 3
  Uniprot ID: Q92784
  ENSP ID: ENSP00000450518
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 22362 - protein, 412 aa, Homo sapiens; identical to SEQ ID NO: 22358
  Payload ID: 4507
  Gene Symbol: DPF3
  Gene Name: D4, zinc and double PHD fingers, family 3
  ENSP ID: ENSP00000479526

SEQ ID NO: 22363 - protein, 367 aa, Homo sapiens; identical to SEQ ID NO: 22360
  Payload ID: 4507
  Gene Symbol: DPF3
  Gene Name: D4, zinc and double PHD fingers, family 3
  Uniprot ID: Q92784
  ENSP ID: ENSP00000481992

SEQ ID NO: 22364 - protein, 770 aa, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENSP ID: ENSP00000313391
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 22365 - protein, 552 aa, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENSP ID: ENSP00000345508
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 22366 - protein, 38 aa, Homo sapiens
  Payload ID: 4508
  Gene Symbol: DAB2
  Gene Name: Dab, mitogen-responsive phosphoprotein, homolog 2 (Drosophila)
  ENSP ID: ENSP00000421086
MSNEVETSATNGQPDQQAAPKAPSKKEKKKGPEKTDEY

SEQ ID NO: 22367 - protein, 116 aa, Homo sapiens
  Payload ID: 4508
  Gene Symbol: DAB2
  Gene Name: Dab, mitogen-responsive phosphoprotein, homolog 2 (Drosophila)
  ENSP ID: ENSP00000421526
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVRIHIC

SEQ ID NO: 22368 - protein, 67 aa, Homo sapiens
  Payload ID: 4508
  Gene Symbol: DAB2
  Gene Name: Dab, mitogen-responsive phosphoprotein, homolog 2 (Drosophila)
  ENSP ID: ENSP00000425088
MSNEVETSATNGQPDQQAAPKAPSKKEKKKGPEKTDEYLLARFKGDGVKYKAKLIGIDDVPDARGDK

SEQ ID NO: 22369 - protein, 749 aa, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENSP ID: ENSP00000426245
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 22370 - protein, 75 aa, Homo sapiens
  Payload ID: 4508
  Gene Symbol: DAB2
  Gene Name: Dab, mitogen-responsive phosphoprotein, homolog 2 (Drosophila)
  ENSP ID: ENSP00000427541
MSNEVETSATNGQPDQQAAPKAPSKKEKKKGPEKTDEYLLARFKGDGVKYKAKLIGIDDVPDARGDKMSQDSMMK

SEQ ID NO: 22371 - protein, 749 aa, Homo sapiens; identical to SEQ ID NO: 22369
  Payload ID: 4508
  Gene Symbol: DAB2
  Gene Name: Dab, mitogen-responsive phosphoprotein, homolog 2 (Drosophila)
  Uniprot ID: P98082
  ENSP ID: ENSP00000439919

SEQ ID NO: 22372 - protein, 204 aa, Homo sapiens
  Payload ID: 4509
  Gene Symbol: DAB1
  Gene Name: Dab, reelin signal transducer, homolog 1 (Drosophila)
  ENSP ID: ENSP00000329120
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQP

SEQ ID NO: 22373 - protein, 213 aa, Homo sapiens
  Payload ID: 4509
  Gene Symbol: DAB1
  Gene Name: Dab, reelin signal transducer, homolog 1 (Drosophila)
  Uniprot ID: O75553
  ENSP ID: ENSP00000360274
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQVISETSRGFRFKSD

SEQ ID NO: 22374 - protein, 588 aa, Homo sapiens
  Payload ID: 4509
  Gene Symbol: DAB1
  Gene Name: Dab, reelin signal transducer, homolog 1 (Drosophila)
  Uniprot ID: O75553
  ENSP ID: ENSP00000360275
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 22375 - protein, 239 aa, Homo sapiens
  Payload ID: 4509
  Gene Symbol: DAB1
  Gene Name: Dab, reelin signal transducer, homolog 1 (Drosophila)
  ENSP ID: ENSP00000360276
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGA

SEQ ID NO: 22376 - protein, 555 aa, Homo sapiens
  Payload ID: 4509
  Gene Symbol: DAB1
  Gene Name: Dab, reelin signal transducer, homolog 1 (Drosophila)
  Uniprot ID: O75553
  ENSP ID: ENSP00000360280
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 22377 - protein, 555 aa, Homo sapiens; identical to SEQ ID NO: 22376
  Payload ID: 4509
  Gene Symbol: DAB1
  Gene Name: Dab, reelin signal transducer, homolog 1 (Drosophila)
  Uniprot ID: O75553
  ENSP ID: ENSP00000387581

SEQ ID NO: 22378 - protein, 553 aa, Homo sapiens
  Payload ID: 4509
  Gene Symbol: DAB1
  Gene Name: Dab, reelin signal transducer, homolog 1 (Drosophila)
  Uniprot ID: O75553
  ENSP ID: ENSP00000395296
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 22379 - protein, 1132 aa, Homo sapiens
  Payload ID: 4510
  Gene Symbol: DAB2IP
  Gene Name: DAB2 interacting protein
  Uniprot ID: Q5VWQ8
  ENSP ID: ENSP00000259371
MEPDSLLDQDDSYESPQERPGSRRSLPGSLSEKSPSMEPSAATPFRVTGFLSRRLKGSIKRTKSQPKLDRNHSFRHILPGFRSAAAAAADNERSHLMPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKESMH

SEQ ID NO: 22380 - protein, 1065 aa, Homo sapiens
  Payload ID: 4510
  Gene Symbol: DAB2IP
  Gene Name: DAB2 interacting protein
  Uniprot ID: Q5VWQ8
  ENSP ID: ENSP00000310827
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKERYSMQARNGISPTNPTKLQITENGEFRNSSNC

SEQ ID NO: 22381 - protein, 1069 aa, Homo sapiens
  Payload ID: 4510
  Gene Symbol: DAB2IP
  Gene Name: DAB2 interacting protein
  ENSP ID: ENSP00000362887
SQPKLDRNHSFRHILPGFRSAAAAAADNERSHLMPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKESMH

SEQ ID NO: 22382 - protein, 291 aa, Homo sapiens
  Payload ID: 4510
  Gene Symbol: DAB2IP
  Gene Name: DAB2 interacting protein
  ENSP ID: ENSP00000377872
MEPDSLLDQDDSYESPQERPGSRRSLPGSLSEKSPSMEPSAATPFRVTGFLSRRLKGSIKRTKSQPKLDRNHSFRHILPGFRSAAAAAADNERSHLMPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPK

SEQ ID NO: 22383 - protein, 1189 aa, Homo sapiens
  Payload ID: 4510
  Gene Symbol: DAB2IP
  Gene Name: DAB2 interacting protein
  Uniprot ID: Q5VWQ8
  ENSP ID: ENSP00000386183
MSAGGSARKSTGRSSYYYRLLRRPRLQRQRSRSRSRTRPARESPQERPGSRRSLPGSLSEKSPSMEPSAATPFRVTGFLSRRLKGSIKRTKSQPKLDRNHSFRHILPGFRSAAAAAADNERSHLMPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTALSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKERYSMQARNGISPTNPTKLQITENGEFRNSSNC

SEQ ID NO: 22384 - protein, 229 aa, Homo sapiens
  Payload ID: 4510
  Gene Symbol: DAB2IP
  Gene Name: DAB2 interacting protein
  ENSP ID: ENSP00000409327
MPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHIT

SEQ ID NO: 22385 - protein, 504 aa, Homo sapiens
  Payload ID: 4511
  Gene Symbol: DACH1
  Gene Name: dachshund family transcription factor 1
  ENSP ID: ENSP00000481551
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 22386 - protein, 706 aa, Homo sapiens
  Payload ID: 4511
  Gene Symbol: DACH1
  Gene Name: dachshund family transcription factor 1
  Uniprot ID: Q9UI36
  ENSP ID: ENSP00000482245
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 22387 - protein, 558 aa, Homo sapiens
  Payload ID: 4511
  Gene Symbol: DACH1
  Gene Name: dachshund family transcription factor 1
  ENSP ID: ENSP00000482493
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 22388 - protein, 758 aa, Homo sapiens
  Payload ID: 4511
  Gene Symbol: DACH1
  Gene Name: dachshund family transcription factor 1
  ENSP ID: ENSP00000482797
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 22389 - protein, 599 aa, Homo sapiens
  Payload ID: 4512
  Gene Symbol: DACH2
  Gene Name: dachshund family transcription factor 2
  Uniprot ID: Q96NX9
  ENSP ID: ENSP00000362217
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARRKRQMTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 22390 - protein, 571 aa, Homo sapiens
  Payload ID: 4512
  Gene Symbol: DACH2
  Gene Name: dachshund family transcription factor 2
  Uniprot ID: Q96NX9
  ENSP ID: ENSP00000362223
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNASSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQA

SEQ ID NO: 22391 - protein, 432 aa, Homo sapiens
  Payload ID: 4512
  Gene Symbol: DACH2
  Gene Name: dachshund family transcription factor 2
  Uniprot ID: Q96NX9
  ENSP ID: ENSP00000420896
MTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 22392 - protein, 440 aa, Homo sapiens
  Payload ID: 4512
  Gene Symbol: DACH2
  Gene Name: dachshund family transcription factor 2
  ENSP ID: ENSP00000421509
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARRKRQMTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMVMMPNNREELIVDQDNGLTIKKFQKDN

SEQ ID NO: 22393 - protein, 380 aa, Homo sapiens
  Payload ID: 4512
  Gene Symbol: DACH2
  Gene Name: dachshund family transcription factor 2
  Uniprot ID: Q96NX9
  ENSP ID: ENSP00000421919
MAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 22394 - protein, 249 aa, Homo sapiens
  Payload ID: 4512
  Gene Symbol: DACH2
  Gene Name: dachshund family transcription factor 2
  ENSP ID: ENSP00000422727
IANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQVNNISINKINGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQA

SEQ ID NO: 22395 - protein, 175 aa, Homo sapiens
  Payload ID: 4512
  Gene Symbol: DACH2
  Gene Name: dachshund family transcription factor 2
  ENSP ID: ENSP00000426837
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARVSLCCPGCSAVV

SEQ ID NO: 22396 - protein, 427 aa, Homo sapiens [sequence omitted]

SEQ ID NO: 22397 - protein, 3298 aa, Homo sapiens
  Payload ID: 4513
  Gene Symbol: DCHS1
  Gene Name: dachsous cadherin-related 1
  Uniprot ID: Q96JQ0
  ENSP ID: ENSP00000299441
MQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 22398 - protein, 1369 aa, Homo sapiens
  Payload ID: 4514
  Gene Symbol: DCHS2
  Gene Name: dachsous cadherin-related 2
  ENSP ID: ENSP00000345062
MSPCGRKMGEGRQQRRAPVGKLLLLPGRRDTPHGRSGSSGARTQRSLLWLLVHVWLWAASGSSAQLFNLTLSVDEGLPPDTLVGDIRAGLPAAQQQEGSGFFLSEDSDDSPLLDDFHVHPDTGIIRTARRLDRERRDHYSFVAATLLGAVVQVEIRVNDVNDHSPRFPLDSLQLDVSELSPPGTAFRLPVAHDPDAGLFSTQGYTLVQPSDLPKDPAGPFFQLRYRTPGPLPSPLLPGSSSPLEPLDLVLLRRLDREEAAAHRLQIEAWDGGRPRRTGLLSVELRVLDENDNPPVFEQDEYRAAVREDAQPGAEVCRVRATDRDLGPNGFVRYSVRARQVPGAGSGGGALGDAAYFAVEELSGVVRVWRPLDREAQAWHQLVVEARDGGAEPEVATVRVSIAVLDVNDNRPAIHVLFLTEGGVARVSEGARPGDYVARVSVSDADGDWEKEDEATGELGVGLGDGSISLSLEGGEGDFALLPGGPPGVFFLCVEGPLDRESRDLYELLLVATDAGSPPLSTEETLLLRVADLNDQPPLFSQQHYKASVSEAAAPGTVVMWVSASDADEAGSDHAWLRYTVVQLSAPCNLGSLQSKMVHTAECGPSFAIDSESGAISTIRTLDREVQEAVELKVVAQDLGEPPLSATCLVSITVDDVNDNEPIFWRQVYNATIAEHAPVGHCFLQVTASDADSGLYGFIEYSLYDGFLSYEAPQAFRIDPHDGQICVSQDIDRERDPATYDLLVEAKDGGGLSAQAFVRVDLEDVNDNHPVFNPSTYVTSISDETQPGTEIINVLATDQDSGIYGTVAYELIPGNVSSLFTIDSTTGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGELINWVALDREHRGHHEMTVLVTDRGSPPRNATMAVYVSVTDINDNRPFFPQCLPGKELHVKVLEGQPVNMLVTTVFAKDPDEGNNAEVTYSVSSARPMPLKGKTAFGKQSCKKQTNKQTNKILT

SEQ ID NO: 22399 - protein, 2916 aa, Homo sapiens
  Payload ID: 4514
  Gene Symbol: DCHS2
  Gene Name: dachsous cadherin-related 2
  ENSP ID: ENSP00000349768
  MOD_RES (1)..(1): Any amino acid
XRLDEITKSENEDGEKKMFTQQFESTDACVYEVYVKINSIVKSQSQCGLKRGSPETELWGAIVFRSQEENAKPVKETEVTASDADSGLYGFIEYSLYDGFLSYEAPQAFRIDPHDGQICVSQDIDRERDPATYDLLVEAKDGDEQRMTHLALVKGGLSAQAFVRVDLEDVNDNHPVFNPSTYVTSISDETQPGTEIINVLATDQDSGIYGTVAYELIPGNVSSLFTIDSTTGLYSPEVEILSAVNFSADKEVMNSLEMFLPLLRHFKKVERDEEAAEKKFEASRGWFMRFKGRRHLHYLKVQDEAASADGEAAARYVANLAKILGEGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGPAGTIYVITWADGAAAFSGTDFAFSSDELQAFVLKSLFCELGEGELINWVALDREHRGHHEMTVLVTDRGSPPRNATMAVYVSVTDINDNRPFFPQCLPGKELHVKVLEGQPVNMLVTTVFAKDPDEGNNAEVTYSVSSEDSSDHFKIDANNGEIRTTTILSYDYRPSYRMSVIATDQGVPPLQGQAVVNIQVIPLSKGRAIMSQNIRHLIIPENLKPTKIMSLIKSSDHLQQHYNGKLHFSIVADDKDGHFEIDSSTGDLFLSKELDYETTSHYLFRVITTDHSKNLSLSSTVFLSIDVEDQNDHSPSFQDELIVISVEENVPIGTLVYVFNAKDDDGSFLNSRIQYYIESHNPGTNPFLIHPSFGTLVTVSRLDRESIPTVILTVTASDQAVNVTDRRLRSLTAQIVILDVNDHNPTFISFPNAHVKEDVTVGSLVHHITAHDPDEGRNGKVTYSILSGNENMTFMLDESSGLLTTTCPLDYEMKTQHILTVLALDDGTPALSSSQTLTVTVLDVNDEAPVFKQHLYEASVKENQNPGEFVTRVEALDRDSGVNSKLQFEIMPGASFELFEINSDTGEVVTTTILDREIQEVFTLRVLVRDGGFPSLSSTTTILCTVEDENDHAPEFIVSSYDIEVLENQEPEVVYTVLASDMDAGNNRAVEYHIIDGNTDECFTINEMSGELSTTRALDREQISNFTLVILCSDLGDPPRSSVIHLQVRVLDANDHSPSFPTLYYQSSVREDAEVGTVVLVLSAVDKDEGLNGQTEYFLTDEASGAFTIDPMSGTLKTSNTLDREARSQHTFSAVARDCSIQGSRSTTVIIKVYVTDVNDNDPVLEQNPFDVFLSPESPTNQTTVIVRADDLDLGPNGTVVFSFAETQSMFSIDKYTGEIQFQQNPSSEYFPIWLQLKVTDQGIPARTTTGLLVIHMEGEDVKISFSHHLYKGLVTENCEAGTSIVTVKAFAPDSIQDSMKYSIFSGNEDGVLSLCSKSGQLTVKEPKFLDFEVRNEVQLIVLAESSGHRAYCKVAVLIQDENDNSPCFEQSIYQASVSESQLYNAHVIQVFATDLDSGLNGLIEYSILSGNQEEAFQIDALSGVITTKAILDYELTSSYSLIVQATDKGMPRLSNTTVIKVQVTDINDNAPAFLPSEAVEITEDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNKTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRHSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 22400 - protein, 2916 aa, Homo sapiens
  Payload ID: 4514
  Gene Symbol: DCHS2
  Gene Name: dachsous cadherin-related 2
  Uniprot ID: Q6V1P9
  ENSP ID: ENSP00000485514
MRLDEITKSENEDGEKKMFTQQFESTDACVYEVYVKINSIVKSQSQCGLKRGSPETELWGAIVFRSQEENAKPVKETEVTASDADSGLYGFIEYSLYDGFLSYEAPQAFRIDPHDGQICVSQDIDRERDPATYDLLVEAKDGDEQRMTHLALVKGGLSAQAFVRVDLEDVNDNHPVFNPSTYVTSISDETQPGTEIINVLATDQDSGIYGTVAYELIPGNVSSLFTIDSTTGLYSPEVEILSAVNFSADKEVMNSLEMFLPLLRHFKKVERDEEAAEKKFEASRGWFMRFKGRRHLHYLKVQDEAASADGEAAARYVANLAKILGEGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGPAGTIYVITWADGAAAFSGTDFAFSSDELQAFVLKSLFCELGEGELINWVALDREHRGHHEMTVLVTDRGSPPRNATMAVYVSVTDINDNRPFFPQCLPGKELHVKVLEGQPVNMLVTTVFAKDPDEGNNAEVTYSVSSEDSSDHFKIDANNGEIRTTTILSYDYRPSYRMSVIATDQGVPPLQGQAVVNIQVIPLSKGRAIMSQNIRHLIIPENLKPTKIMSLIKSSDHLQQHYNGKLHFSIVADDKDGHFEIDSSTGDLFLSKELDYETTSHYLFRVITTDHSKNLSLSSTVFLSIDVEDQNDHSPSFQDELIVISVEENVPIGTLVYVFNAKDDDGSFLNSRIQYYIESHNPGTNPFLIHPSFGTLVTVSRLDRESIPTVILTVTASDQAVNVTDRRLRSLTAQIVILDVNDHNPTFISFPNAHVKEDVTVGSLVHHITAHDPDEGRNGKVTYSILSGNENMTFMLDESSGLLTTTCPLDYEMKTQHILTVLALDDGTPALSSSQTLTVTVLDVNDEAPVFKQHLYEASVKENQNPGEFVTRVEALDRDSGVNSKLQFEIMPGASFELFEINSDTGEVVTTTILDREIQEVFTLRVLVRDGGFPSLSSTTTILCTVEDENDHAPEFIVSSYDIEVLENQEPEVVYTVLASDMDAGNNRAVEYHIIDGNTDECFTINEMSGELSTTRALDREQISNFTLVILCSDLGDPPRSSVIHLQVRVLDANDHSPSFPTLYYQSSVREDAEVGTVVLVLSAVDKDEGLNGQTEYFLTDEASGAFTIDPMSGTLKTSNTLDREARSQHTFSAVARDCSIQGSRSTTVIIKVYVTDVNDNDPVLEQNPFDVFLSPESPTNQTTVIVRADDLDLGPNGTVVFSFAETQSMFSIDKYTGEIQFQQNPSSEYFPIWLQLKVTDQGIPARTTTGLLVIHMEGEDVKISFSHHLYKGLVTENCEAGTSIVTVKAFAPDSIQDSMKYSIFSGNEDGVLSLCSKSGQLTVKEPKFLDFEVRNEVQLIVLAESSGHRAYCKVAVLIQDENDNSPCFEQSIYQASVSESQLYNAHVIQVFATDLDSGLNGLIEYSILSGNQEEAFQIDALSGVITTKAILDYELTSSYSLIVQATDKGMPRLSNTTVIKVQVTDINDNAPAFLPSEAVEITEDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNKTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRHSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 22401 - protein, 382 aa, Homo sapiens
  Payload ID: 4515
  Gene Symbol:
  Gene Name: DADB-110M10.7
  ENSP ID: ENSP00000413440
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 22402 - protein, 228 aa, Homo sapiens; identical to SEQ ID NO: 12141
  Payload ID: 4516
  Gene Symbol:
  Gene Name: DADB-127H9.10
  ENSP ID: ENSP00000392194

SEQ ID NO: 22403 - protein, 212 aa, Homo sapiens
  Payload ID: 4516
  Gene Symbol:
  Gene Name: DADB-127H9.10
  ENSP ID: ENSP00000416121
DFGYCPRVYCENQPMLPIGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 22404 - protein, 304 aa, Homo sapiens; identical to SEQ ID NO: 12174
  Payload ID: 4516
  Gene Symbol:
  Gene Name: DADB-127H9.10
  ENSP ID: ENSP00000479902

SEQ ID NO: 22405 - protein, 228 aa, Homo sapiens; identical to SEQ ID NO: 12141
  Payload ID: 4516
  Gene Symbol:
  Gene Name: DADB-127H9.10
  ENSP ID: ENSP00000482951

SEQ ID NO: 22406 - protein, 161 aa, Homo sapiens; identical to SEQ ID NO: 12169
  Payload ID: 4516
  Gene Symbol:
  Gene Name: DADB-127H9.10
  ENSP ID: ENSP00000483731

SEQ ID NO: 22407 - protein, 376 aa, Homo sapiens
  Payload ID: 4517
  Gene Symbol: DALRD3
  Gene Name: DALR anticodon binding domain containing 3
  Uniprot ID: Q5D0E6
  ENSP ID: ENSP00000323265
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 22408 - protein, 543 aa, Homo sapiens
  Payload ID: 4517
  Gene Symbol: DALRD3
  Gene Name: DALR anticodon binding domain containing 3
  Uniprot ID: Q5D0E6
  ENSP ID: ENSP00000344989
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 22409 - protein, 184 aa, Homo sapiens
  Payload ID: 4517
  Gene Symbol: DALRD3
  Gene Name: DALR anticodon binding domain containing 3
  ENSP ID: ENSP00000396650
  MOD_RES (1)..(1): Any amino acid
XPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNREPRPHLFGQMFVRLQLLRAVREVLHTGLAMLGLPPLSHI

SEQ ID NO: 22410 - protein, 293 aa, Homo sapiens
  Payload ID: 4517
  Gene Symbol: DALRD3
  Gene Name: DALR anticodon binding domain containing 3
  ENSP ID: ENSP00000397385
MATRRLGVGETLGALNAALGPGGPVWIKETRTRHLRSRDFLAPHRALQARFDDGQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMT

SEQ ID NO: 22411 - protein, 386 aa, Homo sapiens
  Payload ID: 4517
  Gene Symbol: DALRD3
  Gene Name: DALR anticodon binding domain containing 3
  ENSP ID: ENSP00000403770
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMVRHRQPGHSTLYSLFWPGAQEQRDGPVTQSLSLDMQVPGTAQHGFQLLLQPGASTTPLWSDVRPPAASESCA

SEQ ID NO: 22412 - protein, 516 aa, Homo sapiens
  Payload ID: 4517
  Gene Symbol: DALRD3
  Gene Name: DALR anticodon binding domain containing 3
  Uniprot ID: Q5D0E6
  ENSP ID: ENSP00000410623
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEYPPLSGSAEPDSSAGLHSPGAPHCCTHRDDMQVPGTAQHGFQLLLQPGTHPGGASTTPLWSDVRPPAASESCA

SEQ ID NO: 22413 - protein, 72 aa, Homo sapiens
  Payload ID: 4517
  Gene Symbol: DALRD3
  Gene Name: DALR anticodon binding domain containing 3
  ENSP ID: ENSP00000485305
MLTFLQQLRVDWPAASERASSHTLRSHALEELTSANDGRTLSPGILGRLCLKELVEEQGRTAGYDPNLDNCL

SEQ ID NO: 22414 - protein, 382 aa, Homo sapiens; identical to SEQ ID NO: 22401
  Payload ID: 4518
  Gene Symbol:
  Gene Name: DAMA-236L13.19
  ENSP ID: ENSP00000412362

SEQ ID NO: 22415 - protein, 228 aa, Homo sapiens; identical to SEQ ID NO: 12141
  Payload ID: 4519
  Gene Symbol:
  Gene Name: DAMA-236L13.20
  ENSP ID: ENSP00000390345

SEQ ID NO: 22416 - protein, 212 aa, Homo sapiens; identical to SEQ ID NO: 22403
  Payload ID: 4519
  Gene Symbol:
  Gene Name: DAMA-236L13.20
  ENSP ID: ENSP00000406867

SEQ ID NO: 22417 - protein, 304 aa, Homo sapiens; identical to SEQ ID NO: 12174
  Payload ID: 4519
  Gene Symbol:
  Gene Name: DAMA-236L13.20
  ENSP ID: ENSP00000477860

SEQ ID NO: 22418 - protein, 228 aa, Homo sapiens; identical to SEQ ID NO: 12141
  Payload ID: 4519
  Gene Symbol:
  Gene Name: DAMA-236L13.20
  ENSP ID: ENSP00000478227

SEQ ID NO: 22419 - protein, 161 aa, Homo sapiens; identical to SEQ ID NO: 12169
  Payload ID: 4519
  Gene Symbol:
  Gene Name: DAMA-236L13.20
  ENSP ID: ENSP00000482874

SEQ ID NO: 22420 - protein, 1140 aa, Homo sapiens [sequence omitted]

SEQ ID NO: 22421 - protein, 1092 aa, Homo sapiens
  Payload ID: 4520
  Gene Symbol: DDB1
  Gene Name: damage-specific DNA binding protein 1, 127kDa
  ENSP ID: ENSP00000440269
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIAVPEPFGGAIIIGQESITYHNGDKYLAIAPPIIKQSTIVCHNRVDPNGSRYLLGDMEGRLFMLLLEKEEQMDGTVTLKDLRVELLGETSIAECLTYLDNGVVFVGSRLGDSQLVKLNVDSNEQGSYVVAMETFTNLGPIVDMCVVDLERQGQGQLVTCSGAFKEGSLRIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVASCNSSQVVVAVGRALYYLQIHPQELRQISHTEMEHEVACLDITPLGDSNGLSPLCAIGLWTDISARILKLPSFELLHKEMLGGEIIPRSILMTTFESSHYLLCALGDGALFYFGLNIETGLLSDRKKVTLGTQPTVLRTFRSLSTTNVFACSDRPTVIYSSNHKLVFSNVNLKEVNYMCPLNSDGYPDSLALANNSTLTIGTIDEIQKLHIRTVPLYESPRKICYQEVSQCFGVLSSRIEVQDTSGGTTALRPSASTQALSSSVSSSKLFSSSTAPHETSFGEEVEVHNLLIIDQHTFEVLHAHQFLQNEYALSLVSCKLGKDPNTYFIVGTAMVYPEEAEPKQGRIVVFQYSDGKLQTVAEKEVKGAVYSMVEFNGKLLASINSTVRLYEWTTEKELRTECNHYNNIMALYLKTKGDFILVGDLMRSVLLLAYKPMEGNFEEIARDFNPNWMSAVEILDDDNFLGAENAFNLFVCQKDSAATTDEERQHLQEVGLFHLGEFVNVFCHGSLVMQNLGETSTPTQGSVLFGTVNGMIGLVTSLSESWYNLLLDMQNRLNKVIKSVGKIEHSFHLEILSHRAEDRTSHRFHRR

SEQ ID NO: 22422 - protein, 109 aa, Homo sapiens
  Payload ID: 4520
  Gene Symbol: DDB1
  Gene Name: damage-specific DNA binding protein 1, 127kDa
  ENSP ID: ENSP00000440660
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQ

SEQ ID NO: 22423 - protein, 139 aa, Homo sapiens
  Payload ID: 4520
  Gene Symbol: DDB1
  Gene Name: damage-specific DNA binding protein 1, 127kDa
  ENSP ID: ENSP00000441825
MYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQVLDQEERARNCE

SEQ ID NO: 22424 - protein, 146 aa, Homo sapiens
  Payload ID: 4520
  Gene Symbol: DDB1
  Gene Name: damage-specific DNA binding protein 1, 127kDa
  ENSP ID: ENSP00000444105
MSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLD

SEQ ID NO: 22425 - protein, 165 aa, Homo sapiens
  Payload ID: 4520
  Gene Symbol: DDB1
  Gene Name: damage-specific DNA binding protein 1, 127kDa
  ENSP ID: ENSP00000445554
MYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLREKEFNKGPWKQENVEAEASMVIA

SEQ ID NO: 22426 - protein, 162 aa, Homo sapiens
  Payload ID: 4520
  Gene Symbol: DDB1
  Gene Name: damage-specific DNA binding protein 1, 127kDa
  ENSP ID: ENSP00000445844
MSYNYVVTAQKPTAVNGCVTGHFTSAEDLNLLIAKNTRLEIYVVTAEGLRPVKEVGMYGKIAVMELFRPKALSSSVSSSKLFSSSTAPHETSFGEEVEVHNLLIIDQHTFEVLHAHQFLQNEYALSLVSCKLGKDPNTYFIVGTAMVYPEEAEPKQGRIVVF

SEQ ID NO: 22427 - protein, 427 aa, Homo sapiens
  Payload ID: 4521
  Gene Symbol: DDB2
  Gene Name: damage-specific DNA binding protein 2, 48kDa
  Uniprot ID: Q92466
  ENSP ID: ENSP00000256996
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 22428 - protein, 238 aa, Homo sapiens
  Payload ID: 4521
  Gene Symbol: DDB2
  Gene Name: damage-specific DNA binding protein 2, 48kDa
  Uniprot ID: Q92466
  ENSP ID: ENSP00000367863
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 22429 - protein, 244 aa, Homo sapiens
  Payload ID: 4521
  Gene Symbol: DDB2
  Gene Name: damage-specific DNA binding protein 2, 48kDa
  Uniprot ID: Q92466
  ENSP ID: ENSP00000367864
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELVSVPMEPGS

SEQ ID NO: 22430 - protein, 363 aa, Homo sapiens
  Payload ID: 4521
  Gene Symbol: DDB2
  Gene Name: damage-specific DNA binding protein 2, 48kDa
  Uniprot ID: Q92466
  ENSP ID: ENSP00000367866
MAPKKRPETQKTSEIVLRPRNKRSRSPLELEPEAKKLCAKGSGPSRRCDSDCLWVGLAGPQILPPCRSIVRTLHQHKLGRASWPSVQQIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 22431 - protein, 91 aa, Homo sapiens
  Payload ID: 4521
  Gene Symbol: DDB2
  Gene Name: damage-specific DNA binding protein 2, 48kDa
  ENSP ID: ENSP00000478063
MAPKKRPETQKTSEIVLRPRNKRSRSPLELEPEAKKLCAKGSDHTDMERPQEVMRQRLTVPNETRLPFGEFSRKTFREIGEENMSVLLGRS

SEQ ID NO: 22432 - protein, 156 aa, Homo sapiens
  Payload ID: 4521
  Gene Symbol: DDB2
  Gene Name: damage-specific DNA binding protein 2, 48kDa
  Uniprot ID: Q92466
  ENSP ID: ENSP00000478411
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGHLVL

SEQ ID NO: 22433 - protein, 93 aa, Homo sapiens
  Payload ID: 4521
  Gene Symbol: DDB2
  Gene Name: damage-specific DNA binding protein 2, 48kDa
  ENSP ID: ENSP00000479196
MAPKKRPETQKTSEIVLRPRNKRSRSPLELEPEAKKLCAKGSGPSRRCDSDCLWVGLAGPQILPPCRSIVRTLHQHKLGRASWPSVQQGLQQS

SEQ ID NO: 22434 - protein, 162 aa, Homo sapiens
  Payload ID: 4521
  Gene Symbol: DDB2
  Gene Name: damage-specific DNA binding protein 2, 48kDa
  ENSP ID: ENSP00000479994
MAPKKRPETQKTSEIVLRPRNKRSRSPLELEPEAKKLCAKGSGTACPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSI

SEQ ID NO: 22435 - protein, 95 aa, Homo sapiens
  Payload ID: 4521
  Gene Symbol: DDB2
  Gene Name: damage-specific DNA binding protein 2, 48kDa
  ENSP ID: ENSP00000482080
  MOD_RES (1)..(1): Any amino acid
XAPFDRRATSLAWHPTHPSTVAVGSKGGDIMLWNFGIKDKPTFIKGIGAGGSITGLKFNPLNTNQFYASSMEGTTRLQDFKGNILRVFASSDTIK

SEQ ID NO: 22436 - protein, 227 aa, Homo sapiens
  Payload ID: 4521
  Gene Symbol: DDB2
  Gene Name: damage-specific DNA binding protein 2, 48kDa
  ENSP ID: ENSP00000483718
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVIL

SEQ ID NO: 22437 - protein, 82 aa, Homo sapiens
  Payload ID: 4522
  Gene Symbol: DAOA
  Gene Name: D-amino acid oxidase activator
  Uniprot ID: P59103
  ENSP ID: ENSP00000329951
MAQRHLQRSLCPWVSYLPQPYAELEEVSSHVGKVFMARNYEFLAYEASKDRRQPLERMWTCNYNQQKDQSCNHKEITSTKAE

SEQ ID NO: 22438 - protein, 153 aa, Homo sapiens
  Payload ID: 4522
  Gene Symbol: DAOA
  Gene Name: D-amino acid oxidase activator
  Uniprot ID: P59103
  ENSP ID: ENSP00000365103
MLEKLMGADSLQLFRSRYTLGKIYFIGFQRSILLSKSENSLNSIAKETEEGRETVTRKEGWKRRHEDGYLEMAQRHLQRSLCPWVSYLPQPYAELEEVSSHVGKVFMARNYEFLAYEASKDRRQPLERMWTCNYNQQKDQSCNHKEITSTKAE

SEQ ID NO: 22439 - protein, 82 aa, Homo sapiens; identical to SEQ ID NO: 22437
  Payload ID: 4522
  Gene Symbol: DAOA
  Gene Name: D-amino acid oxidase activator
  Uniprot ID: P59103
  ENSP ID: ENSP00000453831

SEQ ID NO: 22440 - protein, 125 aa, Homo sapiens
  Payload ID: 4522
  Gene Symbol: DAOA
  Gene Name: D-amino acid oxidase activator
  ENSP ID: ENSP00000469539
MRTAIWKWHRGIYRDHYVLGSLTFLSPMQRAGTSNQWNMGKVMTLDSGDEVTFHKTWPTETGSPYRLEEVSSHVGKVFMARNYEFLAYEASKDRRQPLERMWTCNYNQQKDQSCNHKEITSTKAE

SEQ ID NO: 22441 - protein, 126 aa, Homo sapiens
  Payload ID: 4522
  Gene Symbol: DAOA
  Gene Name: D-amino acid oxidase activator
  Uniprot ID: P59103
  ENSP ID: ENSP00000470244
MLEKLMGADSLQLFRSRYTLGKIYFIGFQRSILLSKSENSLNSIAKETEEGRETVTRKEGWKRRHEDGYLEMAQRHLQRSLCPWVSYLPQPYAEHSKVILNGNLHCHFKRISQIFAGHFMEGDTEA

SEQ ID NO: 22442 - protein, 55 aa, Homo sapiens
  Payload ID: 4522
  Gene Symbol: DAOA
  Gene Name: D-amino acid oxidase activator
  ENSP ID: ENSP00000471091
MAQRHLQRSLCPWVSYLPQPYAEHSKVILNGNLHCHFKRISQIFAGHFMEGDTEA

SEQ ID NO: 22443 - protein, 98 aa, Homo sapiens
  Payload ID: 4522
  Gene Symbol: DAOA
  Gene Name: D-amino acid oxidase activator
  ENSP ID: ENSP00000471306
MLEKLMGADSLQLFRSRYTLGKIYFIGFQRSILLSKSENSLNSIAKETEEGRETVTRKEGWKRRHEDGYLEMAQRHLQRSLCPWVSYLPQPYAESWDF

SEQ ID NO: 22444 - protein, 82 aa, Homo sapiens; identical to SEQ ID NO: 22437
  Payload ID: 4522
  Gene Symbol: DAOA
  Gene Name: D-amino acid oxidase activator
  Uniprot ID: P59103
  ENSP ID: ENSP00000472260

SEQ ID NO: 22445 - protein, 63 aa, Homo sapiens
  Payload ID: 4522
  Gene Symbol: DAOA
  Gene Name: D-amino acid oxidase activator
  ENSP ID: ENSP00000472676
MLEKLMGADSLQLFRSRYTLGKIYFIGFQRSILLSKSENSLNSIGDRRRKRDGNKERRMEEKA

SEQ ID NO: 22446 - protein, 30 aa, Homo sapiens
  Payload ID: 4522
  Gene Symbol: DAOA
  Gene Name: D-amino acid oxidase activator
  ENSP ID: ENSP00000472857
  MOD_RES (1)..(1): Any amino acid
XSKSENSLNSIGSHYVAQAGVQQRLGLPKC

SEQ ID NO: 22447 - protein, 153 aa, Homo sapiens; identical to SEQ ID NO: 22438
  Payload ID: 4522
  Gene Symbol: DAOA
  Gene Name: D-amino acid oxidase activator
  Uniprot ID: P59103
  ENSP ID: ENSP00000483757

SEQ ID NO: 22448 - protein, 347 aa, Homo sapiens
  Payload ID: 4523
  Gene Symbol: DAO
  Gene Name: D-amino-acid oxidase
  Uniprot ID: P14920
  ENSP ID: ENSP00000228476
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 22449 - protein, 281 aa, Homo sapiens
  Payload ID: 4523
  Gene Symbol: DAO
  Gene Name: D-amino-acid oxidase
  ENSP ID: ENSP00000446853
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 22450 - protein, 196 aa, Homo sapiens
  Payload ID: 4523
  Gene Symbol: DAO
  Gene Name: D-amino-acid oxidase
  ENSP ID: ENSP00000447104
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQ

SEQ ID NO: 22451 - protein, 78 aa, Homo sapiens
  Payload ID: 4523
  Gene Symbol: DAO
  Gene Name: D-amino-acid oxidase
  ENSP ID: ENSP00000448095
MRVVVIGAGVIGLSTALCIHERYHSVLQPLDIKVYADRFTPLTTTDVAAGLWQPYLSDPNNPQEATLPGRTQFWDFGS

SEQ ID NO: 22452 - protein, 123 aa, Homo sapiens
  Payload ID: 4523
  Gene Symbol: DAO
  Gene Name: D-amino-acid oxidase
  ENSP ID: ENSP00000449248
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPLWLVPHKPNSGGKELSTVAD

SEQ ID NO: 22453 - protein, 166 aa, Homo sapiens
  Payload ID: 4523
  Gene Symbol: DAO
  Gene Name: D-amino-acid oxidase
  ENSP ID: ENSP00000449967
MFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQI

SEQ ID NO: 22454 - protein, 189 aa, Homo sapiens
  Payload ID: 4524
  Gene Symbol: DAND5
  Gene Name: DAN domain family member 5, BMP antagonist
  Uniprot ID: Q8N907
  ENSP ID: ENSP00000323155
MLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKA

SEQ ID NO: 22455 - protein, 163 aa, Homo sapiens
  Payload ID: 4524
  Gene Symbol: DAND5
  Gene Name: DAN domain family member 5, BMP antagonist
  ENSP ID: ENSP00000467806
MPLTRQQGRLLVTLSPVRTDRQADRRTDKQMLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQTRESRYVAQASLELLASSNPPTSAS

SEQ ID NO: 22456 - protein, 301 aa, Homo sapiens
  Payload ID: 4525
  Gene Symbol:
  Gene Name: DAQB-143M3.10
  ENSP ID: ENSP00000475541
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 22457 - protein, 127 aa, Homo sapiens
  Payload ID: 4525
  Gene Symbol:
  Gene Name: DAQB-143M3.10
  ENSP ID: ENSP00000475961
  MOD_RES (1)..(1): Any amino acid
XHDDLYLNASSFLALINGERDHPNATVWRKNFLRVGHLVLIGGPDDGVITPWQSSFFGFYDANETVLEMEEQLPARPTHQSELLLLRLVCLKPPRRKKPGGNGEREEACRVQRQSESWGPGLSCALS

SEQ ID NO: 22458 - protein, 301 aa, Homo sapiens; identical to SEQ ID NO: 22456
  Payload ID: 4525
  Gene Symbol:
  Gene Name: DAQB-143M3.10
  ENSP ID: ENSP00000476061

SEQ ID NO: 22459 - protein, 70 aa, Homo sapiens
  Payload ID: 4526
  Gene Symbol:
  Gene Name: DAQB-331I12.15
  ENSP ID: ENSP00000429583
  MOD_RES (1)..(1): Any amino acid
XPFPGTIKSRDMSWKRHHLIPETFGVKRRRKRGPVESDPLRGEPEGASRAGGDQNRPAGLRLGCPWNYLH

SEQ ID NO: 22460 - protein, 310 aa, Homo sapiens
  Payload ID: 4527
  Gene Symbol: DDO
  Gene Name: D-aspartate oxidase
  Uniprot ID: Q99489
  ENSP ID: ENSP00000357919
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 22461 - protein, 369 aa, Homo sapiens
  Payload ID: 4527
  Gene Symbol: DDO
  Gene Name: D-aspartate oxidase
  Uniprot ID: Q99489
  ENSP ID: ENSP00000357920
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 22462 - protein, 110 aa, Homo sapiens
  Payload ID: 4527
  Gene Symbol: DDO
  Gene Name: D-aspartate oxidase
  ENSP ID: ENSP00000436642
MRPARHWETRFGARDFGGFQDCFFRDRLMDTARIAVVGAGVVGLSTAVCISKLVPRCSVTIISDKFTPDTTSDVAAGMLIPHTYPVGRYFRALRLKKCHSGLTWFWDFER

SEQ ID NO: 22463 - protein, 99 aa, Homo sapiens; identical to SEQ ID NO: 7151
  Payload ID: 4528
  Gene Symbol:
  Gene Name: DASS-161H22.6
  ENSP ID: ENSP00000454426

SEQ ID NO: 22464 - protein, 382 aa, Homo sapiens
  Payload ID: 4529
  Gene Symbol:
  Gene Name: DASS-312M4.10
  ENSP ID: ENSP00000412832
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCTVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSTCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 22465 - protein, 407 aa, Homo sapiens
  Payload ID: 4530
  Gene Symbol: DAZAP1
  Gene Name: DAZ associated protein 1
  Uniprot ID: Q96EP5
  ENSP ID: ENSP00000233078
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 22466 - protein, 378 aa, Homo sapiens
  Payload ID: 4530
  Gene Symbol: DAZAP1
  Gene Name: DAZ associated protein 1
  Uniprot ID: Q96EP5
  ENSP ID: ENSP00000337132
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGLGSYSPAPPGCGPHFVYSLMVRLSSDVA

SEQ ID NO: 22467 - protein, 406 aa, Homo sapiens
  Payload ID: 4530
  Gene Symbol: DAZAP1
  Gene Name: DAZ associated protein 1
  ENSP ID: ENSP00000465433
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 22468 - protein, 327 aa, Homo sapiens
  Payload ID: 4530
  Gene Symbol: DAZAP1
  Gene Name: DAZ associated protein 1
  ENSP ID: ENSP00000467613
MNNSGADEIGKLFVGGLDWSTTQETLRSYFSQYGEVVDCVIMKDKTTNQSRGFGFVKFKDPNCVGTVLASRPHTLDGRNQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQY

SEQ ID NO: 22469 - protein, 406 aa, Homo sapiens
  Payload ID: 4530
  Gene Symbol: DAZAP1
  Gene Name: DAZ associated protein 1
  ENSP ID: ENSP00000467680
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGYGQDLSGFGQGFSDPSQQPPSYGGPSVPGSGGPPAGGSGFGRGQNHNVQGFHPYRR

SEQ ID NO: 22470 - protein, 168 aa, Homo sapiens
  Payload ID: 4531
  Gene Symbol: DAZAP2
  Gene Name: DAZ associated protein 2
  Uniprot ID: Q15038
  ENSP ID: ENSP00000394699
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 22471 - protein, 86 aa, Homo sapiens
  Payload ID: 4531
  Gene Symbol: DAZAP2
  Gene Name: DAZ associated protein 2
  Uniprot ID: Q15038
  ENSP ID: ENSP00000398804
MNSKGQYPTQPTYPVQPPGNPVYPQTLHLPQAPPYTDAPPAYSEPPPPGCPPNAAQLAVMQGANVLVTQRKGNFFMGGSDGGYTIW

SEQ ID NO: 22472 - protein, 73 aa, Homo sapiens
  Payload ID: 4531
  Gene Symbol: DAZAP2
  Gene Name: DAZ associated protein 2
  ENSP ID: ENSP00000404968
MNSKGQYPTQPTYPVQPPGNPVYPQTLHLPQAPPYTDAPPAYSEGLPQSPPCQPHFLEPLCIFPWPSLWLLGL

SEQ ID NO: 22473 - protein, 153 aa, Homo sapiens
  Payload ID: 4531
  Gene Symbol: DAZAP2
  Gene Name: DAZ associated protein 2
  Uniprot ID: Q15038
  ENSP ID: ENSP00000408251
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPVKEDQDHDREQGEEDNGDNNLERRGKM

SEQ ID NO: 22474 - protein, 146 aa, Homo sapiens
  Payload ID: 4531
  Gene Symbol: DAZAP2
  Gene Name: DAZ associated protein 2
  Uniprot ID: Q15038
  ENSP ID: ENSP00000412812
MNSKGQYPTQPTYPVQPPGNPVYPQTLHLPQAPPYTDAPPAYSELYRPSFVHPGAATVPTMSAAIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 22475 - protein, 136 aa, Homo sapiens
  Payload ID: 4531
  Gene Symbol: DAZAP2
  Gene Name: DAZ associated protein 2
  Uniprot ID: Q15038
  ENSP ID: ENSP00000446554
MNSKGQYPTQPTYPVQPPGNPVYPQTLHLPQAPPYTDAPPAYSESVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 22476 - protein, 108 aa, Homo sapiens
  Payload ID: 4531
  Gene Symbol: DAZAP2
  Gene Name: DAZ associated protein 2
  ENSP ID: ENSP00000447842
MSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 22477 - protein, 207 aa, Homo sapiens
  Payload ID: 4531
  Gene Symbol: DAZAP2
  Gene Name: DAZ associated protein 2
  Uniprot ID: Q15038
  ENSP ID: ENSP00000448051
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPASTSWMPSQCCSACSHAGSQRPRNSAEGELLHGWFRWWLHHLVRNQGHLCAGKDITYLQHFSQCNCFSHINLKLQFRHMLLGCLSGAQTFRHFSNLIRNHVMVAVPP

SEQ ID NO: 22478 - protein, 134 aa, Homo sapiens
  Payload ID: 4531
  Gene Symbol: DAZAP2
  Gene Name: DAZ associated protein 2
  ENSP ID: ENSP00000474597
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPVCVLKLGR

SEQ ID NO: 22479 - protein, 867 aa, Homo sapiens
  Payload ID: 4532
  Gene Symbol: DZIP1
  Gene Name: DAZ interacting zinc finger protein 1
  Uniprot ID: Q86YF9
  ENSP ID: ENSP00000257312
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 22480 - protein, 848 aa, Homo sapiens
  Payload ID: 4532
  Gene Symbol: DZIP1
  Gene Name: DAZ interacting zinc finger protein 1
  Uniprot ID: Q86YF9
  ENSP ID: ENSP00000355018
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKVNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 22481 - protein, 848 aa, Homo sapiens; identical to SEQ ID NO: 22480
  Payload ID: 4532
  Gene Symbol: DZIP1
  Gene Name: DAZ interacting zinc finger protein 1
  Uniprot ID: Q86YF9
  ENSP ID: ENSP00000355175

SEQ ID NO: 22482 - protein, 867 aa, Homo sapiens; identical to SEQ ID NO: 22479
  Payload ID: 4532
  Gene Symbol: DZIP1
  Gene Name: DAZ interacting zinc finger protein 1
  Uniprot ID: Q86YF9
  ENSP ID: ENSP00000366025

SEQ ID NO: 22483 - protein, 277 aa, Homo sapiens
  Payload ID: 4532
  Gene Symbol: DZIP1
  Gene Name: DAZ interacting zinc finger protein 1
  Uniprot ID: Q86YF9
  ENSP ID: ENSP00000431168
MQAEAADWFSSMVRGGRPGRPRRGCRAGENRGFPGPPAPQPARPPSPPPAALSLCPPQPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFGHL

SEQ ID NO: 22484 - protein, 767 aa, Homo sapiens
  Payload ID: 4533
  Gene Symbol: DZIP1L
  Gene Name: DAZ interacting zinc finger protein 1-like
  Uniprot ID: Q8IYY4
  ENSP ID: ENSP00000332148
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSVKSQQSTLVTREAQPKTRTLQVALPSTPAEPPPPTRQSHGSHGSSLTQVSAPAPRPGLHGPSSTPPSSGPGMSTPPFSSEEDSEGDRVQRVSLQPPKVPSRMVPRPKDDWDWSDTETSEENAQPPGQGSGTLVQSMVKNLEKQLEAPAKKPAGGVSLFFMPNAGPQRAATPGRKPQLSEDESDLEISSLEDLPLDLDQREKPKPLSRSKLPEKFGTGPQSSGQPRVPAW

SEQ ID NO: 22485 - protein, 148 aa, Homo sapiens
  Payload ID: 4533
  Gene Symbol: DZIP1L
  Gene Name: DAZ interacting zinc finger protein 1-like
  ENSP ID: ENSP00000417228
  MOD_RES (1)..(1): Any amino acid
XQPPKVPSRMVPRPKDDWDWSDTETSEENAQPPGQGSGTLVQSMVKNLEKQLEAPAKKPAGGVSLFFMPNAGPQRAATPGRKPQVGCRMLRVYSGILYRTSSEFGGPGVKVGEGPASVILCPSGTLWVTSLCPCAHGEMASLEYLYPS

SEQ ID NO: 22486 - protein, 539 aa, Homo sapiens
  Payload ID: 4533
  Gene Symbol: DZIP1L
  Gene Name: DAZ interacting zinc finger protein 1-like
  Uniprot ID: Q8IYY4
  ENSP ID: ENSP00000419486
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSG

SEQ ID NO: 22487 - protein, 39 aa, Homo sapiens
  Payload ID: 4533
  Gene Symbol: DZIP1L
  Gene Name: DAZ interacting zinc finger protein 1-like
  ENSP ID: ENSP00000420051
MQSPAATAEGLSGPLFGAYTFPTFKFQPRHDSMDWRRIS

SEQ ID NO: 22488 - protein, 67 aa, Homo sapiens
  Payload ID: 4533
  Gene Symbol: DZIP1L
  Gene Name: DAZ interacting zinc finger protein 1-like
  ENSP ID: ENSP00000420600
MQSPAATAEGLSGPLFGAYTFPTFKFQPRHDSMDWRRISTLDVDRVARELDVATLQENIAGITFCNL

SEQ ID NO: 22489 - protein, 1208 aa, Homo sapiens
  Payload ID: 4534
  Gene Symbol: DZIP3
  Gene Name: DAZ interacting zinc finger protein 3
  Uniprot ID: Q86Y13
  ENSP ID: ENSP00000355028
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 22490 - protein, 71 aa, Homo sapiens
  Payload ID: 4534
  Gene Symbol: DZIP3
  Gene Name: DAZ interacting zinc finger protein 3
  ENSP ID: ENSP00000417829
MDSLPDEFFVRHPAVEDQRKEETENKLEKSSGQLNKQENDIPTDLVPVNLLLEVKKLLNAINTLPKGVVPH

SEQ ID NO: 22491 - protein, 654 aa, Homo sapiens
  Payload ID: 4534
  Gene Symbol: DZIP3
  Gene Name: DAZ interacting zinc finger protein 3
  ENSP ID: ENSP00000418115
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQE

SEQ ID NO: 22492 - protein, 303 aa, Homo sapiens
  Payload ID: 4534
  Gene Symbol: DZIP3
  Gene Name: DAZ interacting zinc finger protein 3
  Uniprot ID: Q86Y13
  ENSP ID: ENSP00000418871
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPEF

SEQ ID NO: 22493 - protein, 1208 aa, Homo sapiens; identical to SEQ ID NO: 22489
  Payload ID: 4534
  Gene Symbol: DZIP3
  Gene Name: DAZ interacting zinc finger protein 3
  Uniprot ID: Q86Y13
  ENSP ID: ENSP00000419981

SEQ ID NO: 22494 - protein, 126 aa, Homo sapiens
  Payload ID: 4534
  Gene Symbol: DZIP3
  Gene Name: DAZ interacting zinc finger protein 3
  ENSP ID: ENSP00000420030
MQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIG

SEQ ID NO: 22495 - protein, 674 aa, Homo sapiens
  Payload ID: 4535
  Gene Symbol: DBF4
  Gene Name: DBF4 zinc finger
  Uniprot ID: Q9UBU7
  ENSP ID: ENSP00000265728
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQLYRPFYLQLTNMPFINYSIQKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 22496 - protein, 217 aa, Homo sapiens
  Payload ID: 4535
  Gene Symbol: DBF4
  Gene Name: DBF4 zinc finger
  ENSP ID: ENSP00000389397
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRKALQSI

SEQ ID NO: 22497 - protein, 44 aa, Homo sapiens
  Payload ID: 4535
  Gene Symbol: DBF4
  Gene Name: DBF4 zinc finger
  ENSP ID: ENSP00000407116
MNSGAMRIHSKGHFQGGIQVKNEKNRPSLKSLKTDNRPEKSKSS

SEQ ID NO: 22498 - protein, 234 aa, Homo sapiens
  Payload ID: 4535
  Gene Symbol: DBF4
  Gene Name: DBF4 zinc finger
  Uniprot ID: Q9UBU7
  ENSP ID: ENSP00000414083
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQSPAVHLM

SEQ ID NO: 22499 - protein, 615 aa, Homo sapiens
  Payload ID: 4536
  Gene Symbol: DBF4B
  Gene Name: DBF4 zinc finger B
  Uniprot ID: Q8NFT6
  ENSP ID: ENSP00000323663
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASVTQGRAAGQQRWTESLDGVMGPPASHTCVSATTLLPALPKGSREQGCLCPCPASFTQSHLVTSLALLPGEWSPAEDMPLHPSQENSFAPADIPVKGPLLFPEARPWLMSARCWVRPFPFVTWGCLIPHDTTPLHEEVSPCPCLRLGYLYLLLTQSLWCRVRVPSLSTAGPIPRTSHPCTLAFPSYLNDHDLGHLCQAKPQGWNTPQPFLHCGFLAVDSG

SEQ ID NO: 22500 - protein, 431 aa, Homo sapiens
  Payload ID: 4536
  Gene Symbol: DBF4B
  Gene Name: DBF4 zinc finger B
  Uniprot ID: Q8NFT6
  ENSP ID: ENSP00000377178
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQGSISGGGSGGSSSLLTNARSWGVRILHVDEMMMHVQQLSLASLCVKKQQPKKPEGTCPAAESRTRKVARLKAPFLKIEDESRKFRPFHHQFKSFPEISFLGPKDASPFEAPTTLGSMHHTRESKDGEPSPRSAAHTMPRRKKGYCECCQEAFEELHVHLQSAQHRSFALEAHLYAEVDRIIAQLSHSFADIPFQAGLPRWSGSPASDCDPLCPETLHPHQPSHPRAASPRIRKEDSCQASVTQGRAAGQQRWTESLDGVMGPPASHTCHRPCRLP

SEQ ID NO: 22501 - protein, 157 aa, Homo sapiens
  Payload ID: 4536
  Gene Symbol: DBF4B
  Gene Name: DBF4 zinc finger B
  ENSP ID: ENSP00000431158
MSEPGKGDDCLELESSMAESRLRAPDLGVSRCLGKCQKNSPGARKHPFSGKSFYLDLPAGKNLQFLTGAIQQLGGVIEGFLSKEVSYIVSSRREVKAESSGKSHRGCPSPSPSEVRVETSAMVDPKGSHPRPSRKPVDSVPLSRGKELLQKAIRNQK

SEQ ID NO: 22502 - protein, 772 aa, Homo sapiens
  Payload ID: 4537
  Gene Symbol: DCC
  Gene Name: DCC netrin 1 receptor
  ENSP ID: ENSP00000304146
  MOD_RES (1)..(1): Any amino acid
XGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITVRRHNISKLHSNRPQTKHNV

SEQ ID NO: 22503 - protein, 1447 aa, Homo sapiens
  Payload ID: 4537
  Gene Symbol: DCC
  Gene Name: DCC netrin 1 receptor
  Uniprot ID: P43146
  ENSP ID: ENSP00000389140
MENSLRCVWVPKLAFVLFGASLFSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 22504 - protein, 1424 aa, Homo sapiens
  Payload ID: 4537
  Gene Symbol: DCC
  Gene Name: DCC netrin 1 receptor
  ENSP ID: ENSP00000397322
SLCSLVPGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 22505 - protein, 88 aa, Homo sapiens
  Payload ID: 4537
  Gene Symbol: DCC
  Gene Name: DCC netrin 1 receptor
  ENSP ID: ENSP00000463131
RGVPVIKWKKDGIHLALGMDERKQQLSNGSLLIQNILHSRHHKPDEGLYQCEASLGDSGSIISRTAKVAVAEGNVRLRKFGQHSHGSL

SEQ ID NO: 22506 - protein, 70 aa, Homo sapiens
  Payload ID: 4537
  Gene Symbol: DCC
  Gene Name: DCC netrin 1 receptor
  ENSP ID: ENSP00000463463
VPVIKWKKDGIHLALGMDERKQQLSNGSLLIQNILHSRHHKPDEGLYQCEASLGDSGSIISRTAKVAVAD

SEQ ID NO: 22507 - protein, 181 aa, Homo sapiens
  Payload ID: 4537
  Gene Symbol: DCC
  Gene Name: DCC netrin 1 receptor
  ENSP ID: ENSP00000463699
  MOD_RES (1)..(1): Any amino acid
XIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGANIRILPRRSTSSCAAVWKMYPRALEYAQNSIWEGLVTVQSFPFYIYRDIVYFQMISRKLNCSDSVILNDLMIFI

SEQ ID NO: 22508 - protein, 102 aa, Homo sapiens
  Payload ID: 4537
  Gene Symbol: DCC
  Gene Name: DCC netrin 1 receptor
  ENSP ID: ENSP00000463766
MDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRL

SEQ ID NO: 22509 - protein, 74 aa, Homo sapiens
  Payload ID: 4537
  Gene Symbol: DCC
  Gene Name: DCC netrin 1 receptor
  ENSP ID: ENSP00000464277
  MOD_RES (1)..(1): Any amino acid
XVPVIKWKKDGIHLALGMDERKQQLSNGSLLIQNILHSRHHKPDEGLYQCEASLGDSGSIISRTAKVAVAGLCS

SEQ ID NO: 22510 - protein, 208 aa, Homo sapiens
  Payload ID: 4537
  Gene Symbol: DCC
  Gene Name: DCC netrin 1 receptor
  ENSP ID: ENSP00000464292
  MOD_RES (1)..(1): Any amino acid
XSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQDTGVTINLVNEVLLG

SEQ ID NO: 22511 - protein, 1076 aa, Homo sapiens
  Payload ID: 4537
  Gene Symbol: DCC
  Gene Name: DCC netrin 1 receptor
  ENSP ID: ENSP00000464582
MDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRTVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVEMEWVKQYAISYYPLLLPASSFSV

SEQ ID NO: 22512 - protein, 189 aa, Homo sapiens
  Payload ID: 4538
  Gene Symbol: DCTD
  Gene Name: dCMP deaminase
  Uniprot ID: P32321
  ENSP ID: ENSP00000349576
MVGGGQPCGPNMSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 22513 - protein, 178 aa, Homo sapiens
  Payload ID: 4538
  Gene Symbol: DCTD
  Gene Name: dCMP deaminase
  Uniprot ID: P32321
  ENSP ID: ENSP00000398194
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 22514 - protein, 73 aa, Homo sapiens
  Payload ID: 4538
  Gene Symbol: DCTD
  Gene Name: dCMP deaminase
  ENSP ID: ENSP00000421792
MSEVSCKKRDDYLEWPEYFMAVAFLSAQRSKDPNSQVGACIVNSENKIVGIGYNGMPNGCSDDVLPWRRTAEN

SEQ ID NO: 22515 - protein, 44 aa, Homo sapiens
  Payload ID: 4538
  Gene Symbol: DCTD
  Gene Name: dCMP deaminase
  ENSP ID: ENSP00000422386
MLGLSPHRALVGVQPHQEKAPRGLTGPFPLLLFPRPPWLPLPPI

SEQ ID NO: 22516 - protein, 169 aa, Homo sapiens
  Payload ID: 4538
  Gene Symbol: DCTD
  Gene Name: dCMP deaminase
  ENSP ID: ENSP00000422662
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSI

SEQ ID NO: 22517 - protein, 59 aa, Homo sapiens
  Payload ID: 4538
  Gene Symbol: DCTD
  Gene Name: dCMP deaminase
  ENSP ID: ENSP00000422729
MSEVSCKKRDDYLEWPEYFMAVAFLSAQRSKDPNSQVGACIVNSENKIVGIGYNGMPNG

SEQ ID NO: 22518 - protein, 119 aa, Homo sapiens
  Payload ID: 4538
  Gene Symbol: DCTD
  Gene Name: dCMP deaminase
  ENSP ID: ENSP00000423182
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQ

SEQ ID NO: 22519 - protein, 44 aa, Homo sapiens; identical to SEQ ID NO: 22515
  Payload ID: 4538
  Gene Symbol: DCTD
  Gene Name: dCMP deaminase
  ENSP ID: ENSP00000423498

SEQ ID NO: 22520 - protein, 98 aa, Homo sapiens
  Payload ID: 4538
  Gene Symbol: DCTD
  Gene Name: dCMP deaminase
  ENSP ID: ENSP00000423894
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDV

SEQ ID NO: 22521 - protein, 178 aa, Homo sapiens; identical to SEQ ID NO: 22513
  Payload ID: 4538
  Gene Symbol: DCTD
  Gene Name: dCMP deaminase
  Uniprot ID: P32321
  ENSP ID: ENSP00000424017

SEQ ID NO: 22522 - protein, 120 aa, Homo sapiens
  Payload ID: 4538
  Gene Symbol: DCTD
  Gene Name: dCMP deaminase
  ENSP ID: ENSP00000424050
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQA

SEQ ID NO: 22523 - protein, 41 aa, Homo sapiens
  Payload ID: 4538
  Gene Symbol: DCTD
  Gene Name: dCMP deaminase
  ENSP ID: ENSP00000425287
MSEVSCKKRDDYLEWPEYFMAVAFLSAQRSKDPNSQCAMRS

SEQ ID NO: 22524 - protein, 41 aa, Homo sapiens; identical to SEQ ID NO: 22523
  Payload ID: 4538
  Gene Symbol: DCTD
  Gene Name: dCMP deaminase
  ENSP ID: ENSP00000425462

SEQ ID NO: 22525 - protein, 17 aa, Homo sapiens
  Payload ID: 4538
  Gene Symbol: DCTD
  Gene Name: dCMP deaminase
  ENSP ID: ENSP00000425904
MVGGGQPCGWASVLTGL

SEQ ID NO: 22526 - protein, 23 aa, Homo sapiens
  Payload ID: 4538
  Gene Symbol: DCTD
  Gene Name: dCMP deaminase
  ENSP ID: ENSP00000427282
MSEVSCKKRDDYLEWPEYFMAVA

SEQ ID NO: 22527 - protein, 44 aa, Homo sapiens; identical to SEQ ID NO: 22515
  Payload ID: 4538
  Gene Symbol: DCTD
  Gene Name: dCMP deaminase
  ENSP ID: ENSP00000427470

SEQ ID NO: 22528 - protein, 259 aa, Homo sapiens
  Payload ID: 4539
  Gene Symbol: DCUN1D1
  Gene Name: DCN1, defective in cullin neddylation 1, domain containing 1
  Uniprot ID: Q96GG9
  ENSP ID: ENSP00000292782
MNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 22529 - protein, 128 aa, Homo sapiens
  Payload ID: 4539
  Gene Symbol: DCUN1D1
  Gene Name: DCN1, defective in cullin neddylation 1, domain containing 1
  ENSP ID: ENSP00000417675
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPK

SEQ ID NO: 22530 - protein, 92 aa, Homo sapiens
  Payload ID: 4539
  Gene Symbol: DCUN1D1
  Gene Name: DCN1, defective in cullin neddylation 1, domain containing 1
  ENSP ID: ENSP00000418913
MIFTQSSEKTAVSCLSQNDWKLDVATDNFFQNPELYIRESVKGSLDRKKLEQLYNRYKDPQDENKIGIDGIQQFCDDLALDPASISVLIIAW

SEQ ID NO: 22531 - protein, 35 aa, Homo sapiens
  Payload ID: 4539
  Gene Symbol: DCUN1D1
  Gene Name: DCN1, defective in cullin neddylation 1, domain containing 1
  ENSP ID: ENSP00000418935
MNKLKSSQKDKVRQFMIFTQSSEKTATLKMRIKLE

SEQ ID NO: 22532 - protein, 244 aa, Homo sapiens
  Payload ID: 4539
  Gene Symbol: DCUN1D1
  Gene Name: DCN1, defective in cullin neddylation 1, domain containing 1
  ENSP ID: ENSP00000419359
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 22533 - protein, 98 aa, Homo sapiens
  Payload ID: 4539
  Gene Symbol: DCUN1D1
  Gene Name: DCN1, defective in cullin neddylation 1, domain containing 1
  ENSP ID: ENSP00000419440
MIFTQSSEKTAVSCLSQNDWKLDVATDNFFQNPELYIRESVKGSLDRKKLEQLYNRYKDPQDENKIGIDGIQQFCDDLALDPASISVLIIAWKFRAAT

SEQ ID NO: 22534 - protein, 75 aa, Homo sapiens
  Payload ID: 4539
  Gene Symbol: DCUN1D1
  Gene Name: DCN1, defective in cullin neddylation 1, domain containing 1
  ENSP ID: ENSP00000420073
MIFTQSSEKTAVSCLSQNDWKLDVATDNFFQNPELYIRESVKGSLDRKKLEQLYNRYKDPQDENKIGIDGIQQFC

SEQ ID NO: 22535 - protein, 244 aa, Homo sapiens; identical to SEQ ID NO: 22532
  Payload ID: 4539
  Gene Symbol: DCUN1D1
  Gene Name: DCN1, defective in cullin neddylation 1, domain containing 1
  ENSP ID: ENSP00000488427

SEQ ID NO: 22536 - protein, 126 aa, Homo sapiens
  Payload ID: 4540
  Gene Symbol: DCUN1D2
  Gene Name: DCN1, defective in cullin neddylation 1, domain containing 2
  ENSP ID: ENSP00000330629
MEKLKALLPRLEQELKDTAKFKDFYQFTFTFAKNPGQKGLDLEMAVAYWKLVLSGRFKFLDLWNTFLMEHHKRSIPRDTWNLLLDFGNMIADDMSNYDEEGAWPVLIDDFVEYARPVVTGGKRSLF

SEQ ID NO: 22537 - protein, 186 aa, Homo sapiens
  Payload ID: 4540
  Gene Symbol: DCUN1D2
  Gene Name: DCN1, defective in cullin neddylation 1, domain containing 2
  Uniprot ID: Q6PH85
  ENSP ID: ENSP00000364552
MHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLGSPPFLNVKALHH

SEQ ID NO: 22538 - protein, 244 aa, Homo sapiens
  Payload ID: 4540
  Gene Symbol: DCUN1D2
  Gene Name: DCN1, defective in cullin neddylation 1, domain containing 2
  ENSP ID: ENSP00000403543
  MOD_RES (1)..(1): Any amino acid
XRRRRRAGCGRPSPASCAGRSAWIRGRNAPRAREPERWRRRRGTAGSAGLTRSREGRPGHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLGSPPFLNVKALHH

SEQ ID NO: 22539 - protein, 90 aa, Homo sapiens
  Payload ID: 4540
  Gene Symbol: DCUN1D2
  Gene Name: DCN1, defective in cullin neddylation 1, domain containing 2
  ENSP ID: ENSP00000414773
MACTQAGERTAIYCLTQNEWRLDEATDSFFQNPDSLHRESMRNAVDKKKLERLYGRYKDPQDENKIGVDGIQQFCDDLSLDPASISVLVI

SEQ ID NO: 22540 - protein, 17 aa, Homo sapiens
  Payload ID: 4540
  Gene Symbol: DCUN1D2
  Gene Name: DCN1, defective in cullin neddylation 1, domain containing 2
  ENSP ID: ENSP00000417394
MACTQAGERTAIYCLTQ

SEQ ID NO: 22541 - protein, 119 aa, Homo sapiens
  Payload ID: 4540
  Gene Symbol: DCUN1D2
  Gene Name: DCN1, defective in cullin neddylation 1, domain containing 2
  ENSP ID: ENSP00000417398
MPGVGVPAAGSRHCPGAEGRGRPRTRAEPPPRLRRRPGPARSGRRGGDDPQDENKIGVDGIQQFCDDLSLDPASISVLVIAWKFRAATQCEFSRKEFLDGMTELGCDSMEKLKALLPRL

SEQ ID NO: 22542 - protein, 259 aa, Homo sapiens
  Payload ID: 4540
  Gene Symbol: DCUN1D2
  Gene Name: DCN1, defective in cullin neddylation 1, domain containing 2
  Uniprot ID: Q6PH85
  ENSP ID: ENSP00000417706
MHKLKSSQKDKVRQFMACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLDLEMAVAYWKLVLSGRFKFLDLWNTFLMEHHKRSIPRDTWNLLLDFGNMIADDMSNYDEEGAWPVLIDDFVEYARPVVTGGKRSLF

SEQ ID NO: 22543 - protein, 134 aa, Homo sapiens
  Payload ID: 4540
  Gene Symbol: DCUN1D2
  Gene Name: DCN1, defective in cullin neddylation 1, domain containing 2
  ENSP ID: ENSP00000418030
MACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELK

SEQ ID NO: 22544 - protein, 304 aa, Homo sapiens
  Payload ID: 4541
  Gene Symbol: DCUN1D3
  Gene Name: DCN1, defective in cullin neddylation 1, domain containing 3
  Uniprot ID: Q8IWE4
  ENSP ID: ENSP00000319482
MGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRKEFFDGCKAISADSIDGICARFPSLLTEAKQEDKFKDLYRFTFQFGLDSEEGQRSLHREIAIALWKLVFTQNNPPVLDQWLNFLTENPSGIKGISRDTWNMFLNFTQVIGPDLSNYSEDEAWPSLFDTFVEWEMERRKREGEGRGALSSGPEGLCPEEQT

SEQ ID NO: 22545 - protein, 304 aa, Homo sapiens; identical to SEQ ID NO: 22544
  Payload ID: 4541
  Gene Symbol: DCUN1D3
  Gene Name: DCN1, defective in cullin neddylation 1, domain containing 3
  Uniprot ID: Q8IWE4
  ENSP ID: ENSP00000454762

SEQ ID NO: 22546 - protein, 292 aa, Homo sapiens
  Payload ID: 4542
  Gene Symbol: DCUN1D4
  Gene Name: DCN1, defective in cullin neddylation 1, domain containing 4
  Uniprot ID: Q92564
  ENSP ID: ENSP00000334625
MHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 22547 - protein, 257 aa, Homo sapiens
  Payload ID: 4542
  Gene Symbol: DCUN1D4
  Gene Name: DCN1, defective in cullin neddylation 1, domain containing 4
  Uniprot ID: Q92564
  ENSP ID: ENSP00000370850
MHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARQSKYKVINKDQWCNVLEFSRTINLDLSNYDEDGAWPVLLDEFVEWYKDKQMS

SEQ ID NO: 22548 - protein, 336 aa, Homo sapiens
  Payload ID: 4542
  Gene Symbol: DCUN1D4
  Gene Name: DCN1, defective in cullin neddylation 1, domain containing 4
  Uniprot ID: Q92564
  ENSP ID: ENSP00000389900
MEVEAALGCSGQGRGCGGVAPAGRGRERASERGTRVRISKGLSGAGGSVRKADFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 22549 - protein, 63 aa, Homo sapiens
  Payload ID: 4542
  Gene Symbol: DCUN1D4
  Gene Name: DCN1, defective in cullin neddylation 1, domain containing 4
  ENSP ID: ENSP00000421127
MHSDAAAVSFTGSMVLASAWLLESLTIVEEGEWRAGTPHGESRSEREKGFSAELSSLNTGKYS

SEQ ID NO: 22550 - protein, 207 aa, Homo sapiens
  Payload ID: 4542
  Gene Symbol: DCUN1D4
  Gene Name: DCN1, defective in cullin neddylation 1, domain containing 4
  ENSP ID: ENSP00000421699
MEVEAALGCSGQGRGCGGVAPAGRGRERASERGTRVRISKGLSGAGGSVRKADFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENMESRTVARLECNGMMSAHCNLCLPG

SEQ ID NO: 22551 - protein, 116 aa, Homo sapiens
  Payload ID: 4542
  Gene Symbol: DCUN1D4
  Gene Name: DCN1, defective in cullin neddylation 1, domain containing 4
  ENSP ID: ENSP00000422711
  MOD_RES (1)..(1): Any amino acid
XTDDVVGPEGMEKFCEDIGVEPENVVMLVLAWKLDAQNMGYFTLQEWLKGMTSLQCDTTEKLRNTLDYLRSFLNDSTNFKLIYRYAFDFARAEDGVSDCELLAGTLAEQEKRTSAA

SEQ ID NO: 22552 - protein, 21 aa, Homo sapiens
  Payload ID: 4542
  Gene Symbol: DCUN1D4
  Gene Name: DCN1, defective in cullin neddylation 1, domain containing 4
  ENSP ID: ENSP00000423794
NFKLIYRYAFDFARFYMMLES

SEQ ID NO: 22553 - protein, 24 aa, Homo sapiens
  Payload ID: 4542
  Gene Symbol: DCUN1D4
  Gene Name: DCN1, defective in cullin neddylation 1, domain containing 4
  ENSP ID: ENSP00000423808
MHSDAAAVNISFRECGVEKFSRKE

SEQ ID NO: 22554 - protein, 143 aa, Homo sapiens
  Payload ID: 4542
  Gene Symbol: DCUN1D4
  Gene Name: DCN1, defective in cullin neddylation 1, domain containing 4
  ENSP ID: ENSP00000424476
MHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVSQTY

SEQ ID NO: 22555 - protein, 46 aa, Homo sapiens
  Payload ID: 4542
  Gene Symbol: DCUN1D4
  Gene Name: DCN1, defective in cullin neddylation 1, domain containing 4
  ENSP ID: ENSP00000425644
MHSDAAAVNFQLNSHLSTLANIHKIYHTLNKLEVCGLAVLQTALIK

SEQ ID NO: 22556 - protein, 46 aa, Homo sapiens; identical to SEQ ID NO: 22555
  Payload ID: 4542
  Gene Symbol: DCUN1D4
  Gene Name: DCN1, defective in cullin neddylation 1, domain containing 4
  ENSP ID: ENSP00000425792

SEQ ID NO: 22557 - protein, 102 aa, Homo sapiens
  Payload ID: 4542
  Gene Symbol: DCUN1D4
  Gene Name: DCN1, defective in cullin neddylation 1, domain containing 4
  ENSP ID: ENSP00000426048
LFYSTGVVKRNDFSPEKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 22558 - protein, 212 aa, Homo sapiens
  Payload ID: 4542
  Gene Symbol: DCUN1D4
  Gene Name: DCN1, defective in cullin neddylation 1, domain containing 4
  ENSP ID: ENSP00000426982
MEVEAALGCSGQGRGCGGVAPAGRGRERASERGTRVRISKGLSGAGGSVRKADFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSL

SEQ ID NO: 22559 - protein, 237 aa, Homo sapiens
  Payload ID: 4543
  Gene Symbol: DCUN1D5
  Gene Name: DCN1, defective in cullin neddylation 1, domain containing 5
  Uniprot ID: Q9BTE7
  ENSP ID: ENSP00000260247
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 22560 - protein, 71 aa, Homo sapiens
  Payload ID: 4543
  Gene Symbol: DCUN1D5
  Gene Name: DCN1, defective in cullin neddylation 1, domain containing 5
  ENSP ID: ENSP00000431311
MPVKKKRKSPGVAAAVAEDGGLKKCKISRYHLPPPFKLPSSLLCWTTGGKGVGPGLPGWGWRQLLQIPTPC

SEQ ID NO: 22561 - protein, 195 aa, Homo sapiens
  Payload ID: 4543
  Gene Symbol: DCUN1D5
  Gene Name: DCN1, defective in cullin neddylation 1, domain containing 5
  ENSP ID: ENSP00000432027
  MOD_RES (1)..(1): Any amino acid
XYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEGLFFLMNLLSGKKSVRHHSKNYVKKMQTFQFPRVYKLM

SEQ ID NO: 22562 - protein, 84 aa, Homo sapiens
  Payload ID: 4543
  Gene Symbol: DCUN1D5
  Gene Name: DCN1, defective in cullin neddylation 1, domain containing 5
  ENSP ID: ENSP00000432488
MPVKKKRKSPGVAAAVAEDGGLKKCKISSYCRSQPPARLISGEEHFSSKKCLAWFYEYAGPDEVVGPEGMEKFCEDIGVEPENV

SEQ ID NO: 22563 - protein, 67 aa, Homo sapiens
  Payload ID: 4543
  Gene Symbol: DCUN1D5
  Gene Name: DCN1, defective in cullin neddylation 1, domain containing 5
  ENSP ID: ENSP00000433073
MPVKKKRKSPGVAAAVAEDGGLKKCKISRYHLPPPFKLPSSLLCWTTGGKGVGPGLPGWGWRQVRPL

SEQ ID NO: 22564 - protein, 68 aa, Homo sapiens
  Payload ID: 4543
  Gene Symbol: DCUN1D5
  Gene Name: DCN1, defective in cullin neddylation 1, domain containing 5
  ENSP ID: ENSP00000433134
  MOD_RES (1)..(1): Any amino acid
XKKRKSPGVAAAVAEDGGLKKCKISRYHLPPPFKLPSSLLCWTTGGKGVGPGLPGWGWRQLLQIPTPC

SEQ ID NO: 22565 - protein, 30 aa, Homo sapiens
  Payload ID: 4543
  Gene Symbol: DCUN1D5
  Gene Name: DCN1, defective in cullin neddylation 1, domain containing 5
  ENSP ID: ENSP00000433344
MPVKKKRKSPGVAAAVAEDGGLKKCKISRS

SEQ ID NO: 22566 - protein, 152 aa, Homo sapiens
  Payload ID: 4543
  Gene Symbol: DCUN1D5
  Gene Name: DCN1, defective in cullin neddylation 1, domain containing 5
  ENSP ID: ENSP00000435035
MPVKKKRKSPGVAAAVAEDGGLKKCKISRCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 22567 - protein, 30 aa, Homo sapiens; identical to SEQ ID NO: 22565
  Payload ID: 4543
  Gene Symbol: DCUN1D5
  Gene Name: DCN1, defective in cullin neddylation 1, domain containing 5
  ENSP ID: ENSP00000437260

SEQ ID NO: 22568 - protein, 42 aa, Homo sapiens
  Payload ID: 4543
  Gene Symbol: DCUN1D5
  Gene Name: DCN1, defective in cullin neddylation 1, domain containing 5
  ENSP ID: ENSP00000463796
IIMLVLAWKLEAESMGFFTKEEWLKGMTSLQLSITELAFLFV

SEQ ID NO: 22569 - protein, 706 aa, Homo sapiens
  Payload ID: 4544
  Gene Symbol: DCST1
  Gene Name: DC-STAMP domain containing 1
  Uniprot ID: Q5T197
  ENSP ID: ENSP00000295542
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 22570 - protein, 664 aa, Homo sapiens
  Payload ID: 4544
  Gene Symbol: DCST1
  Gene Name: DC-STAMP domain containing 1
  Uniprot ID: Q5T197
  ENSP ID: ENSP00000357404
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPVFTEPQFLPLKNGKTGEICKACSLEISLEWWSGVGLRCQRA

SEQ ID NO: 22571 - protein, 681 aa, Homo sapiens
  Payload ID: 4544
  Gene Symbol: DCST1
  Gene Name: DC-STAMP domain containing 1
  Uniprot ID: Q5T197
  ENSP ID: ENSP00000387369
MDIKHHQNGTRGQRRKQPHTTVQRLLTWGLPVSCSWFLWRQPGEFPVTALLLGAGAGGLLAIGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 22572 - protein, 528 aa, Homo sapiens
  Payload ID: 4544
  Gene Symbol: DCST1
  Gene Name: DC-STAMP domain containing 1
  ENSP ID: ENSP00000433667
MAQEGKEENSLIPVSPASIHLQALNPNEPHPRQKSGLLSYPVPLLAVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSRRQS

SEQ ID NO: 22573 - protein, 773 aa, Homo sapiens
  Payload ID: 4545
  Gene Symbol: DCST2
  Gene Name: DC-STAMP domain containing 2
  Uniprot ID: Q5T1A1
  ENSP ID: ENSP00000357409
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGLYCLTCFRLLDNTCSVCASPLSYQGDLDLELDSSDEEGPQLWLAAAQRKDPEQAWLLQQQLQEVLGRSLSMESTSESSDLDEEKGPQQRKHGQQPLPEAHQPVSILTSPEPHRPPETSSATKGAPTPASEPSVPLSPPSLPDPSHPPPK

SEQ ID NO: 22574 - protein, 639 aa, Homo sapiens
  Payload ID: 4545
  Gene Symbol: DCST2
  Gene Name: DC-STAMP domain containing 2
  Uniprot ID: Q5T1A1
  ENSP ID: ENSP00000436964
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGFICKWHCSSSLVCTP

SEQ ID NO: 22575 - protein, 19 aa, Homo sapiens
  Payload ID: 4545
  Gene Symbol: DCST2
  Gene Name: DC-STAMP domain containing 2
  ENSP ID: ENSP00000437330
LLRPSEPDSTGYIVIGAPA

SEQ ID NO: 22576 - protein, 170 aa, Homo sapiens
  Payload ID: 4546
  Gene Symbol: DCTPP1
  Gene Name: dCTP pyrophosphatase 1
  Uniprot ID: Q9H773
  ENSP ID: ENSP00000322524
MSVAGGEIRGDTGGEDTAAPGRFSFSPEPTLEDIRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 22577 - protein, 49 aa, Homo sapiens
  Payload ID: 4546
  Gene Symbol: DCTPP1
  Gene Name: dCTP pyrophosphatase 1
  ENSP ID: ENSP00000455391
MDINRRRYPAHLARSSSRKYTELPHGAISEDQAVGPADIPCDSTGQTST

SEQ ID NO: 22578 - protein, 71 aa, Homo sapiens
  Payload ID: 4546
  Gene Symbol: DCTPP1
  Gene Name: dCTP pyrophosphatase 1
  ENSP ID: ENSP00000456612
MSVAGGEIPRCRVDLPLAVLSKMDINRRRYPAHLARSSSRKYTELPHGAISEDQAVGPADIPCDSTGQTST

SEQ ID NO: 22579 - protein, 49 aa, Homo sapiens; identical to SEQ ID NO: 22577
  Payload ID: 4546
  Gene Symbol: DCTPP1
  Gene Name: dCTP pyrophosphatase 1
  ENSP ID: ENSP00000460764

SEQ ID NO: 22580 - protein, 49 aa, Homo sapiens; identical to SEQ ID NO: 22577
  Payload ID: 4546
  Gene Symbol: DCTPP1
  Gene Name: dCTP pyrophosphatase 1
  ENSP ID: ENSP00000460933

SEQ ID NO: 22581 - protein, 386 aa, Homo sapiens
  Payload ID: 4547
  Gene Symbol: DCAF10
  Gene Name: DDB1 and CUL4 associated factor 10
  ENSP ID: ENSP00000242323
MLSRSHRSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSDLTTSSSSSGPRVSGSPCHHSDSNSSEKHMSRASQREGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 22582 - protein, 559 aa, Homo sapiens
  Payload ID: 4547
  Gene Symbol: DCAF10
  Gene Name: DDB1 and CUL4 associated factor 10
  Uniprot ID: Q5QP82
  ENSP ID: ENSP00000366953
MFPFGPHSPGGDGSAGAGAEEPTPHEGQAAATGPPSPLHPGADATHPPPPARSPRRPGAPSLSPAPRSGELGLPGAPESSTASAPGEPSPPSPPCRRPGPDCRAKSRGRHGLGAGLGGPGARLFGWLKERSLGRGLFVDPARDNFRTMTSLYGSIHPADSVYLSTRTHGAVFNLEYSPDGSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSDLTTSSSSSGPRVSGSPCHHSDSNSSEKHMSRASQREGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 22583 - protein, 71 aa, Homo sapiens
  Payload ID: 4548
  Gene Symbol: DCAF11
  Gene Name: DDB1 and CUL4 associated factor 11
  ENSP ID: ENSP00000323680
MGSRNSSSAGSGSGDPSEGLPRRGAGLRRSEEEEEEDEDVDLAQRPSEVGAGRRCSKFTIHSGPLGLRGRE

SEQ ID NO: 22584 - protein, 446 aa, Homo sapiens
  Payload ID: 4548
  Gene Symbol: DCAF11
  Gene Name: DDB1 and CUL4 associated factor 11
  Uniprot ID: Q8TEB1
  ENSP ID: ENSP00000380142
MTELGMVVLGIDTTHLWMLPLTPGSWNSMRSRHKWNWPQGSWGLGGPPRSTAFLECCTSFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 22585 - protein, 520 aa, Homo sapiens
  Payload ID: 4548
  Gene Symbol: DCAF11
  Gene Name: DDB1 and CUL4 associated factor 11
  Uniprot ID: Q8TEB1
  ENSP ID: ENSP00000380146
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 22586 - protein, 546 aa, Homo sapiens
  Payload ID: 4548
  Gene Symbol: DCAF11
  Gene Name: DDB1 and CUL4 associated factor 11
  Uniprot ID: Q8TEB1
  ENSP ID: ENSP00000415556
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 22587 - protein, 546 aa, Homo sapiens; identical to SEQ ID NO: 22586
  Payload ID: 4548
  Gene Symbol: DCAF11
  Gene Name: DDB1 and CUL4 associated factor 11
  Uniprot ID: Q8TEB1
  ENSP ID: ENSP00000452898

SEQ ID NO: 22588 - protein, 142 aa, Homo sapiens
  Payload ID: 4548
  Gene Symbol: DCAF11
  Gene Name: DDB1 and CUL4 associated factor 11
  ENSP ID: ENSP00000452915
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGL

SEQ ID NO: 22589 - protein, 137 aa, Homo sapiens
  Payload ID: 4548
  Gene Symbol: DCAF11
  Gene Name: DDB1 and CUL4 associated factor 11
  ENSP ID: ENSP00000453035
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGLGGPPRSTAFLECCTRENGASAIGEASPLENSLE

SEQ ID NO: 22590 - protein, 122 aa, Homo sapiens
  Payload ID: 4548
  Gene Symbol: DCAF11
  Gene Name: DDB1 and CUL4 associated factor 11
  ENSP ID: ENSP00000453074
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGL

SEQ ID NO: 22591 - protein, 265 aa, Homo sapiens
  Payload ID: 4548
  Gene Symbol: DCAF11
  Gene Name: DDB1 and CUL4 associated factor 11
  ENSP ID: ENSP00000453115
PDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSVRLQGLRVLAHVWGLDLGGGSTS

SEQ ID NO: 22592 - protein, 145 aa, Homo sapiens
  Payload ID: 4548
  Gene Symbol: DCAF11
  Gene Name: DDB1 and CUL4 associated factor 11
  ENSP ID: ENSP00000453132
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGLGGPPRSTAFLECCTSFLPNDLGFTDSYSQKAFCGIYSKDGQ

SEQ ID NO: 22593 - protein, 56 aa, Homo sapiens
  Payload ID: 4548
  Gene Symbol: DCAF11
  Gene Name: DDB1 and CUL4 associated factor 11
  ENSP ID: ENSP00000453184
MGSRNSSSAGSGSGDPSEGLPRRGAGLRRSEEEEEEDEDVDLAQVLAYLLRSGCYP

SEQ ID NO: 22594 - protein, 116 aa, Homo sapiens
  Payload ID: 4548
  Gene Symbol: DCAF11
  Gene Name: DDB1 and CUL4 associated factor 11
  ENSP ID: ENSP00000453208
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGL

SEQ ID NO: 22595 - protein, 30 aa, Homo sapiens
  Payload ID: 4548
  Gene Symbol: DCAF11
  Gene Name: DDB1 and CUL4 associated factor 11
  ENSP ID: ENSP00000453290
MGSRNSSSAGSGSGDPSEGLPRRGAGLRRS

SEQ ID NO: 22596 - protein, 67 aa, Homo sapiens
  Payload ID: 4548
  Gene Symbol: DCAF11
  Gene Name: DDB1 and CUL4 associated factor 11
  ENSP ID: ENSP00000453381
MGSRNSSSAGSGSGDPSEGLPRRGAGLRRSEEEEEEDEDVDLAQRPSEVGAGRRCSKFTIHSGPLGL

SEQ ID NO: 22597 - protein, 71 aa, Homo sapiens; identical to SEQ ID NO: 22583
  Payload ID: 4548
  Gene Symbol: DCAF11
  Gene Name: DDB1 and CUL4 associated factor 11
  ENSP ID: ENSP00000453462

SEQ ID NO: 22598 - protein, 108 aa, Homo sapiens
  Payload ID: 4548
  Gene Symbol: DCAF11
  Gene Name: DDB1 and CUL4 associated factor 11
  ENSP ID: ENSP00000453470
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNE

SEQ ID NO: 22599 - protein, 149 aa, Homo sapiens
  Payload ID: 4548
  Gene Symbol: DCAF11
  Gene Name: DDB1 and CUL4 associated factor 11
  ENSP ID: ENSP00000453505
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKA

SEQ ID NO: 22600 - protein, 71 aa, Homo sapiens; identical to SEQ ID NO: 22583
  Payload ID: 4548
  Gene Symbol: DCAF11
  Gene Name: DDB1 and CUL4 associated factor 11
  ENSP ID: ENSP00000453550

SEQ ID NO: 22601 - protein, 118 aa, Homo sapiens
  Payload ID: 4548
  Gene Symbol: DCAF11
  Gene Name: DDB1 and CUL4 associated factor 11
  ENSP ID: ENSP00000453587
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGLGGPPRSTAFLECCT

SEQ ID NO: 22602 - protein, 56 aa, Homo sapiens; identical to SEQ ID NO: 22593
  Payload ID: 4548
  Gene Symbol: DCAF11
  Gene Name: DDB1 and CUL4 associated factor 11
  ENSP ID: ENSP00000453632

SEQ ID NO: 22603 - protein, 128 aa, Homo sapiens
  Payload ID: 4548
  Gene Symbol: DCAF11
  Gene Name: DDB1 and CUL4 associated factor 11
  ENSP ID: ENSP00000453678
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQS

SEQ ID NO: 22604 - protein, 56 aa, Homo sapiens; identical to SEQ ID NO: 22593
  Payload ID: 4548
  Gene Symbol: DCAF11
  Gene Name: DDB1 and CUL4 associated factor 11
  ENSP ID: ENSP00000453803

SEQ ID NO: 22605 - protein, 93 aa, Homo sapiens
  Payload ID: 4548
  Gene Symbol: DCAF11
  Gene Name: DDB1 and CUL4 associated factor 11
  ENSP ID: ENSP00000453805
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNP

SEQ ID NO: 22606 - protein, 71 aa, Homo sapiens; identical to SEQ ID NO: 22583
  Payload ID: 4548
  Gene Symbol: DCAF11
  Gene Name: DDB1 and CUL4 associated factor 11
  ENSP ID: ENSP00000453814

SEQ ID NO: 22607 - protein, 106 aa, Homo sapiens
  Payload ID: 4548
  Gene Symbol: DCAF11
  Gene Name: DDB1 and CUL4 associated factor 11
  ENSP ID: ENSP00000453826
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGLGG

SEQ ID NO: 22608 - protein, 90 aa, Homo sapiens
  Payload ID: 4548
  Gene Symbol: DCAF11
  Gene Name: DDB1 and CUL4 associated factor 11
  ENSP ID: ENSP00000453832
MGSRNSSSAGSGSGDPSEGLPRRGAGLRRSEEEEEEDEDVDLAQALLDSEEENDRAWDGRLGDRYNPPVDATPDTRELEFNEIKTQVELA

SEQ ID NO: 22609 - protein, 182 aa, Homo sapiens
  Payload ID: 4548
  Gene Symbol: DCAF11
  Gene Name: DDB1 and CUL4 associated factor 11
  ENSP ID: ENSP00000453916
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRK

SEQ ID NO: 22610 - protein, 73 aa, Homo sapiens
  Payload ID: 4548
  Gene Symbol: DCAF11
  Gene Name: DDB1 and CUL4 associated factor 11
  ENSP ID: ENSP00000454044
MGSRNSSSAGSGSGDPSEGLPRRGAGLRRSEEEEEEDEDVDLAQVLAYLLRRGQVRLVQGGGAANLQFIQALL

SEQ ID NO: 22611 - protein, 154 aa, Homo sapiens
  Payload ID: 4548
  Gene Symbol: DCAF11
  Gene Name: DDB1 and CUL4 associated factor 11
  ENSP ID: ENSP00000454129
MGSRNSSSAGSGSGDPSEGLPRRGAGLRRSEEEEEEDEDVDLAQVLAYLLRRGQVRLVQGGGAANLQFIQALLDSEEENDRAWDGRLGDRYNPPVDATPDTRELEFNEIKTQVELATGQLGLRRAAQKHSFPRMLHQRERGLCHRGSFSLGEQS

SEQ ID NO: 22612 - protein, 104 aa, Homo sapiens
  Payload ID: 4548
  Gene Symbol: DCAF11
  Gene Name: DDB1 and CUL4 associated factor 11
  ENSP ID: ENSP00000454139
MGSRNSSSAGSGSGDPSEGLPRRGAGLRRSEEEEEEDEDVDLAQVLAYLLRRPSWTQRKRMTELGMVVLGIDTTHLWMLPLTPGSWNSMRSRHKWNWPQGSWGL

SEQ ID NO: 22613 - protein, 453 aa, Homo sapiens
  Payload ID: 4549
  Gene Symbol: DCAF12
  Gene Name: DDB1 and CUL4 associated factor 12
  Uniprot ID: Q5T6F0
  ENSP ID: ENSP00000355114
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 22614 - protein, 227 aa, Homo sapiens
  Payload ID: 4549
  Gene Symbol: DCAF12
  Gene Name: DDB1 and CUL4 associated factor 12
  ENSP ID: ENSP00000380187
MEPQGYPAFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPK

SEQ ID NO: 22615 - protein, 189 aa, Homo sapiens
  Payload ID: 4549
  Gene Symbol: DCAF12
  Gene Name: DDB1 and CUL4 associated factor 12
  ENSP ID: ENSP00000415833
MQPMSFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLW

SEQ ID NO: 22616 - protein, 463 aa, Homo sapiens
  Payload ID: 4550
  Gene Symbol: DCAF12L1
  Gene Name: DDB1 and CUL4 associated factor 12-like 1
  Uniprot ID: Q5VU92
  ENSP ID: ENSP00000360167
MAQQQTGSRKRKAPAVEADAESSPSQGLAAADGEGPLLLKRQRRPATYRSMAHYLKVREVGGWGPARLQGFDGELRGYAVQRLPELLTERQLELGTVNKVFASQWLNSRQVVCGTKCNTLFVVDVESGHIARIPLLRDSEARLAQDQQGCGIHAIELNPSKTLLATGGENPNSLAIYQLPSLDPLCLGDRHGHKDWIFAVAWLSDTVAVSGSRDGTVALWRMDPDKFDDTVAWHSEVGLPVYAHIRPRDVEAIPRAIINPSNRKVRALACGGKNQELGAVSLDGYFHLWKAGSALSRLLSIRLPYFRDNVCLTYCDDMSVYAVGSHSHVSFLDLRQDQQNIRPLCSREGGTGVRSLSFYRHIITVGTGQGSLLFYDVRAQKFLEERASATLESSSGPARRKLRLACGRGWLNHNDFWVNYFGGMEVFPNALYTHCYNWPEMKLFVAGGPLPAGLHGNYAGLWS

SEQ ID NO: 22617 - protein, 463 aa, Homo sapiens
  Payload ID: 4551
  Gene Symbol: DCAF12L2
  Gene Name: DDB1 and CUL4 associated factor 12-like 2
  Uniprot ID: Q5VW00
  ENSP ID: ENSP00000353128
MAQQQTGSRKRKAPAVEAGAGSSSSQGLAAADGEGPLLPKKQKRPATRRRLVHYLKGREVGARGPAGLQGFEGELRGYAVQRLPELLTERQLDLGTLNKVFASQWLNARQVVCGTKCNTLFVVDVQSGHITRIPLMRDKEAGLAQAHQGCGIHAIELNPSKTLLATGGENPNSLAIYQLPTLDPLCLGDRHGHKDWIFAVAWLSDTVAVSGSRDGTVALWRMDPDMFNGSIAWHSEVGLPVYAHIRPRDVEAIPRASTNPSNRKVRALAFSGKNQELGAVSLDGYFHLWKARSTLSRLLSIRLPYCRENVCLTYCDELSLYAVGSQSHVSFLDPRQRQQNIRPLCSREGGTGVRSLSFYQHIITVGTGHGSLLFYDIRAQKFLEERASSSLDSMPGPAGRKLKLACGRGWLNQDDVWVNYFGGMGEFPNALYTHCYNWPEMKLFVAGGPLPSGLHGNYAGLWS

SEQ ID NO: 22618 - protein, 597 aa, Homo sapiens
  Payload ID: 4552
  Gene Symbol: DCAF13
  Gene Name: DDB1 and CUL4 associated factor 13
  ENSP ID: ENSP00000297579
MQWPPPWRRSPLVSATPPPGPTRGLLCPRRVSEAGDSSTEGARTGHRHYVTPAESAMEGRSQPLPSLRPASPTNAPAHGRGSDCTAKEPPLANVCRQNYGAAQDPVEPAGRRSASHVTGSSLGKAEVACGRRWRWAELLADTSWSPAGRATEMKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIETFLLGSCASDRNIVLYDMRQATPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 22619 - protein, 221 aa, Homo sapiens
  Payload ID: 4552
  Gene Symbol: DCAF13
  Gene Name: DDB1 and CUL4 associated factor 13
  ENSP ID: ENSP00000430411
MKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIEVMFFFKYVLLIMA

SEQ ID NO: 22620 - protein, 185 aa, Homo sapiens
  Payload ID: 4552
  Gene Symbol: DCAF13
  Gene Name: DDB1 and CUL4 associated factor 13
  ENSP ID: ENSP00000430883
MKVKMLSRNPDNYVRETKLDLQRVPRNYDPALHPFEVPREYIRALNATKLERVFAKPFLASLDGHRDGVNCLAKHPEKLATVLSGACDGEVGDDKTVKQWKMDGPGYGDEEEPLHTILGKTVYTGIDHHWKEAVFATCGQQVDIWDEQRTNPICSMTWGFDSISSVKFNPIEVMFFFKYVLLIMA

SEQ ID NO: 22621 - protein, 597 aa, Homo sapiens; identical to SEQ ID NO: 22618
  Payload ID: 4552
  Gene Symbol: DCAF13
  Gene Name: DDB1 and CUL4 associated factor 13
  ENSP ID: ENSP00000477526

SEQ ID NO: 22622 - protein, 96 aa, Homo sapiens
  Payload ID: 4552
  Gene Symbol: DCAF13
  Gene Name: DDB1 and CUL4 associated factor 13
  Uniprot ID: Q9NV06
  ENSP ID: ENSP00000480810
MKVKMLSRNPDNYVRETKLDLQRVPRNYDPALHPFEVPREYIRALNATKLERVFAKPFLASLDGHRDGVNCLAKHPEKLATVLSGACDGELVMTKL

SEQ ID NO: 22623 - protein, 204 aa, Homo sapiens
  Payload ID: 4552
  Gene Symbol: DCAF13
  Gene Name: DDB1 and CUL4 associated factor 13
  ENSP ID: ENSP00000484168
MDGPGYGDEEEPLHTILGKTVYTGIDHHWKEAVFATCGQQVDIWDEQRTNPICSMTWGFDSISSVKFNPIETFLLGSCASDRNIVLYDMRQATPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIM

SEQ ID NO: 22624 - protein, 445 aa, Homo sapiens
  Payload ID: 4552
  Gene Symbol: DCAF13
  Gene Name: DDB1 and CUL4 associated factor 13
  Uniprot ID: Q9NV06
  ENSP ID: ENSP00000484962
MKVKMLSRNPDNYVRETKLDLQRVPRNYDPALHPFEVPREYIRALNATKLERVFAKPFLASLDGHRDGVNCLAKHPEKLATVLSGACDGEVRIWNLTQRNCIRTIQAHEGFVRGICTRFCGTSFFTVGDDKTVKQWKMDGPGYGDEEEPLHTILGKTVYTGIDHHWKEAVFATCGQQVDIWDEQRTNPICSMTWGFDSISSVKFNPIETFLLGSCASDRNIVLYDMRQATPLKKVILDMRTNTICWNPMEAFIFTAANEDYNLYTFDMRALDTPVMVHMDHVSAVLDVDYSPTGKEFVSASFDKSIRIFPVDKSRSREVYHTKRMQHVICVKWTSDSKYIMCGSDEMNIRLWKANASEKLGVLTSREKAAKDYNQKLKEKFQHYPHIKRIARHRHLPKSIYSQIQEQRIMKEARRRKEVNRIKHSKPGSVPLVSEKKKHVVAVVK

SEQ ID NO: 22625 - protein, 600 aa, Homo sapiens
  Payload ID: 4553
  Gene Symbol: DCAF15
  Gene Name: DDB1 and CUL4 associated factor 15
  Uniprot ID: Q66K64
  ENSP ID: ENSP00000254337
MAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 22626 - protein, 272 aa, Homo sapiens
  Payload ID: 4553
  Gene Symbol: DCAF15
  Gene Name: DDB1 and CUL4 associated factor 15
  ENSP ID: ENSP00000466048
  MOD_RES (1)..(1): Any amino acid
XVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQVGVGSGRAKDSPGELPGGSWHRPLRLPTHPQGQYLTVEQLTLDFEYVINEVIRHDATW

SEQ ID NO: 22627 - protein, 54 aa, Homo sapiens
  Payload ID: 4553
  Gene Symbol: DCAF15
  Gene Name: DDB1 and CUL4 associated factor 15
  ENSP ID: ENSP00000466932
APSSKSERNSGAGSGGGGPGGAGGKRAAGRRREHVLKQLERVKSPCRWLWASSA

SEQ ID NO: 22628 - protein, 201 aa, Homo sapiens
  Payload ID: 4553
  Gene Symbol: DCAF15
  Gene Name: DDB1 and CUL4 associated factor 15
  ENSP ID: ENSP00000468330
  MOD_RES (1)..(1): Any amino acid
XPLPASPELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 22629 - protein, 216 aa, Homo sapiens
  Payload ID: 4554
  Gene Symbol: DCAF16
  Gene Name: DDB1 and CUL4 associated factor 16
  Uniprot ID: Q9NXF7
  ENSP ID: ENSP00000371682
MGPRNPSPDHLSESESEEEENISYLNESSGEEWDSSEEEDSMVPNLSPLESLAWQVKCLLKYSTTWKPLNPNSWLYHAKLLDPSTPVHILREIGLRLSHCSHCVPKLEPIPEWPPLASCGVPPFQKPLTSPSRLSRDHATLNGALQFATKQLSRTLSRATPIPEYLKQIPNSCVSGCCCGWLTKTVKETTRTEPINTTYSYTDFQKAVNKLLTASL

SEQ ID NO: 22630 - protein, 271 aa, Homo sapiens
  Payload ID: 4555
  Gene Symbol: DCAF17
  Gene Name: DDB1 and CUL4 associated factor 17
  ENSP ID: ENSP00000342160
  MOD_RES (1)..(1): Any amino acid
XRHSTTCFAVPCSVPSSTFFTCRDSRDQQKDMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 22631 - protein, 520 aa, Homo sapiens
  Payload ID: 4555
  Gene Symbol: DCAF17
  Gene Name: DDB1 and CUL4 associated factor 17
  Uniprot ID: Q5H9S7
  ENSP ID: ENSP00000364404
MGPTRKPNVCSRLSRRALGCFSRDAGVVQRTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQFMQQKLDLGCACRWGGTTGTVGEAPFGIPCNIKITDMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 22632 - protein, 128 aa, Homo sapiens
  Payload ID: 4555
  Gene Symbol: DCAF17
  Gene Name: DDB1 and CUL4 associated factor 17
  ENSP ID: ENSP00000400335
  MOD_RES (1)..(1): Any amino acid
XRTNLGILRALVCQESTKFKNVWTTHSRSPIAYERGRIYFDNYRRCVSSVASEPRKLYEMPKCSKSEKIEDALLWECPVMESSVARLECSGTISAHRNLHLPGSSDSPASASQVAGIIGRYTSQFIRL

SEQ ID NO: 22633 - protein, 222 aa, Homo sapiens
  Payload ID: 4555
  Gene Symbol: DCAF17
  Gene Name: DDB1 and CUL4 associated factor 17
  ENSP ID: ENSP00000403992
  MOD_RES (1)..(1): Any amino acid
XEIKLNDFCKASEVNISKLMFVPSASGYKAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 22634 - protein, 453 aa, Homo sapiens
  Payload ID: 4555
  Gene Symbol: DCAF17
  Gene Name: DDB1 and CUL4 associated factor 17
  ENSP ID: ENSP00000442238
MGPTRKPNVCSRLSRRALGCFSRDAGVVQRTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQFMQQKLDLGCACRWGGTTGTVGEAPFGIPCNIKITDMPPLLFEVSSLENAFQIGGHPWHYIVTPNKKKQKGVFHICALKDNSLNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 22635 - protein, 240 aa, Homo sapiens
  Payload ID: 4555
  Gene Symbol: DCAF17
  Gene Name: DDB1 and CUL4 associated factor 17
  Uniprot ID: Q5H9S7
  ENSP ID: ENSP00000477604
MPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 22636 - protein, 325 aa, Homo sapiens
  Payload ID: 4556
  Gene Symbol: DCAF4
  Gene Name: DDB1 and CUL4 associated factor 4
  ENSP ID: ENSP00000345176
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKADTNSDRLFTVNDVKVGGSKYGIINLQSLKTPTLKVFMHENLYFTNRKAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 22637 - protein, 495 aa, Homo sapiens
  Payload ID: 4556
  Gene Symbol: DCAF4
  Gene Name: DDB1 and CUL4 associated factor 4
  Uniprot ID: Q8WV16
  ENSP ID: ENSP00000351147
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 22638 - protein, 395 aa, Homo sapiens
  Payload ID: 4556
  Gene Symbol: DCAF4
  Gene Name: DDB1 and CUL4 associated factor 4
  Uniprot ID: Q8WV16
  ENSP ID: ENSP00000377781
MESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 22639 - protein, 74 aa, Homo sapiens
  Payload ID: 4556
  Gene Symbol: DCAF4
  Gene Name: DDB1 and CUL4 associated factor 4
  ENSP ID: ENSP00000422270
MNKSRWQSRRRHGRRSHQQNPWFRLRDSEDRSDSRAAQPAHDSGHGDDESPSTSSGTAGTSSVPETLLPLAPWT

SEQ ID NO: 22640 - protein, 435 aa, Homo sapiens
  Payload ID: 4556
  Gene Symbol: DCAF4
  Gene Name: DDB1 and CUL4 associated factor 4
  Uniprot ID: Q8WV16
  ENSP ID: ENSP00000426178
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 22641 - protein, 333 aa, Homo sapiens
  Payload ID: 4556
  Gene Symbol: DCAF4
  Gene Name: DDB1 and CUL4 associated factor 4
  ENSP ID: ENSP00000451186
MESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPGIDRPGMLCSFRIPGAWSCAWSLNIQANNCFSTGLSRRVLLTNVVTGHRQSFGTNSDVLAQQFALMAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAGT

SEQ ID NO: 22642 - protein, 489 aa, Homo sapiens
  Payload ID: 4556
  Gene Symbol: DCAF4
  Gene Name: DDB1 and CUL4 associated factor 4
  Uniprot ID: Q8WV16
  ENSP ID: ENSP00000452131
MNKSRWQSRRRHGRRSHQQNPWFRLRDSEDRSDSRAAQPAHDSGHGDDESPSTSSGTAGTSSVPELPGFYFDPEKKRYFRLLPGHNNCNPLTKESIRQKEMESKRLRLLQEEDRRKKIARMGFNASSMLRKSQLGFLNVTNYCHLAHELRLSCMERKKVQIRSMDPSALASDRFNLILADTNSDRLFTVNDVKVGGSKYGIINLQSLKTPTLKVFMHENLYFTNRKVNSVCWASLNHLDSHILLCLMGLAETPGCATLLPASLFVNSHPAGIDRPGMLCSFRIPGAWSCAWSLNIQANNCFSTGLSRRVLLTNVVTGHRQSFGTNSDVLAPLLFNGCRSGEIFAIDLRCGNQGKGWKATRLFHDSAVTSVRILQDEQYLMASDMAGKIKLWDLRTTKCVRQYEGHVNEYAYLPLHVHEEEGILVAVGQDCYTRIWSLHDARLLRTIPSPYPASKADIPSVAFSSRLGGSRGAPGLLMAVGQDLYCYSYS

SEQ ID NO: 22643 - protein, 396 aa, Homo sapiens
  Payload ID: 4557
  Gene Symbol: DCAF4L1
  Gene Name: DDB1 and CUL4 associated factor 4-like 1
  Uniprot ID: Q3SXM0
  ENSP ID: ENSP00000327796
MEAERLRLLEEEAKLKKVARMGFNASSMLRKSQLGFLNVTSYSRLANELRVSCMERKKVQIRSLDPSSLASDRFNFILASTNSDQLFVVNQVEVEGSKYGIISLRTLKIPSFHVYVLRNLYVPNRKVKSLCWASLNQLDSHVLLCFEGITDAPSCAVLLPASRFLSVHTRVNQPGMLCSFQIPEAWSCAWSLNTRAYHCFSAGLSQQVLLTSVATGHQQSFDTSSDVLAQQFASTAPLLFNGCRSGEIFAIDLRCRNRGKGWRATRLFHDSAVTSVQILQEEQCLMASDMTGKIKLWDLRATKCVRQYEGHVNESAYLPLHVHEEEGIVVAVGQDCYTRIWSLHDAHLLRTIPSPYSASEDDIPSVAFASRLGGIRGAAPGLLMAVRQDLYCFPFS

SEQ ID NO: 22644 - protein, 395 aa, Homo sapiens
  Payload ID: 4558
  Gene Symbol: DCAF4L2
  Gene Name: DDB1 and CUL4 associated factor 4-like 2
  Uniprot ID: Q8NA75
  ENSP ID: ENSP00000316496
MESKRPRLLEEADKQKKTVRVGLNAPSMLRKNQLGFLRFANYCRIARELRVSCMQRKKVQIHSWDPSSLASDRFNRILANTNTDQLFTVNQVEAGGSKYGIITMRGLTTPELRVYPHKTLYVPNRKVNSMCWASLNHLDSHLLLCFVGLADTPSCAVLLPASLFIGSFPGMRRPGMLCSFQIPDAWSCAWSLSIHAYHSFSTGLSQQVLLTNVVTGHQQSFGTSSDVLAQQFAIMTPLLFNGCRSGEIFGIDLRCGNQGSGWKAICLSHDSAVTSLQILQDGQFLVSSDMTGTIKLWDLRATKCVTQYEGHVNNSAYLPVHVNEEEGVVAAVGQDCYTRIWSLRHGHLLTTIPSPYPASENDIPSVAFSSRLGGFRGAPGLLMAVREDLYCFSYG

SEQ ID NO: 22645 - protein, 942 aa, Homo sapiens
  Payload ID: 4559
  Gene Symbol: DCAF5
  Gene Name: DDB1 and CUL4 associated factor 5
  Uniprot ID: Q96JK2
  ENSP ID: ENSP00000341351
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 22646 - protein, 326 aa, Homo sapiens
  Payload ID: 4559
  Gene Symbol: DCAF5
  Gene Name: DDB1 and CUL4 associated factor 5
  ENSP ID: ENSP00000374647
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQHHNWKWRAQAVSFQPFLSLTRNGDADVDLKLAV

SEQ ID NO: 22647 - protein, 210 aa, Homo sapiens
  Payload ID: 4559
  Gene Symbol: DCAF5
  Gene Name: DDB1 and CUL4 associated factor 5
  ENSP ID: ENSP00000451394
MEQAIHSRVKPIQLKGEHHSNIFCLAFNSGNTKVFSGGNDEQVILHDVESETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQ

SEQ ID NO: 22648 - protein, 860 aa, Homo sapiens
  Payload ID: 4559
  Gene Symbol: DCAF5
  Gene Name: DDB1 and CUL4 associated factor 5
  Uniprot ID: Q96JK2
  ENSP ID: ENSP00000451551
MEQAIHSRVKPIQLKGEHHSNIFCLAFNSGNTKVFSGGNDEQVILHDVESSETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 22649 - protein, 941 aa, Homo sapiens
  Payload ID: 4559
  Gene Symbol: DCAF5
  Gene Name: DDB1 and CUL4 associated factor 5
  Uniprot ID: Q96JK2
  ENSP ID: ENSP00000451845
MKRRAGLGGSMRSVVGFLSQRGLHGDPLLTQDFQRRRLRGCRNLYKKDLLGHFGCVNAIEFSNNGGQWLVSGGDDRRVLLWHMEQAIHSRVKPIQLKGEHHSNIFCLAFNSGNTKVFSGGNDEQVILHDVESETLDVFAHEDAVYGLSVSPVNDNIFASSSDDGRVLIWDIRESPHGEPFCLANYPSAFHSVMFNPVEPRLLATANSKEGVGLWDIRKPQSSLLRYGGNLSLQSAMSVRFNSNGTQLLALRRRLPPVLYDIHSRLPVFQFDNQGYFNSCTMKSCCFAGDRDQYILSGSDDFNLYMWRIPADPEAGGIGRVVNGAFMVLKGHRSIVNQVRFNPHTYMICSSGVEKIIKIWSPYKQPGCTGDLDGRIEDDSRCLYTHEEYISLVLNSGSGLSHDYANQSVQEDPRMMAFFDSLVRREIEGWSSDSDSDLSESTILQLHAGVSERSGYTDSESSASLPRSPPPTVDESADNAFHLGPLRVTTTNTVASTPPTPTCEDAASRQQRLSALRRYQDKRLLALSNESDSEENVCEVELDTDLFPRPRSPSPEDESSSSSSSSSSEDEEELNERRASTWQRNAMRRRQKTTREDKPSAPIKPTNTYIGEDNYDYPQIKVDDLSSSPTSSPERSTSTLEIQPSRASPTSDIESVERKIYKAYKWLRYSYISYSNNKDGETSLVTGEADEGRAGTSHKDNPAPSSSKEACLNIAMAQRNQDLPPEGCSKDTFKEETPRTPSNGPGHEHSSHAWAEVPEGTSQDTGNSGSVEHPFETKKLNGKALSSRAEEPPSPPVPKASGSTLNSGSGNCPRTQSDDSEERSLETICANHNNGRLHPRPPHPHNNGQNLGELEVVAYSSPGHSDTDRDNSSLTGTLLHKDCCGSEMACETPNAGTREDPTDTPATDSSRAVHGHSGLKRQRIELEDTDSENSSSEKKLKT

SEQ ID NO: 22650 - protein, 860 aa, Homo sapiens; identical to SEQ ID NO: 22648
  Payload ID: 4559
  Gene Symbol: DCAF5
  Gene Name: DDB1 and CUL4 associated factor 5
  Uniprot ID: Q96JK2
  ENSP ID: ENSP00000452052

SEQ ID NO: 22651 - protein, 83 aa, Homo sapiens
  Payload ID: 4559
  Gene Symbol: DCAF5
  Gene Name: DDB1 and CUL4 associated factor 5
  ENSP ID: ENSP00000452077
MTTFLPVPQMMAGFSFGTFGNPPMESPSAWQTIHQPFIVSCLTLWSPGCWPQPIQRKEWDSGTFENLRVLSCAMVETCPSKVP

SEQ ID NO: 22652 - protein, 860 aa, Homo sapiens
  Payload ID: 4560
  Gene Symbol: DCAF6
  Gene Name: DDB1 and CUL4 associated factor 6
  Uniprot ID: Q58WW2
  ENSP ID: ENSP00000311949
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 22653 - protein, 951 aa, Homo sapiens
  Payload ID: 4560
  Gene Symbol: DCAF6
  Gene Name: DDB1 and CUL4 associated factor 6
  Uniprot ID: Q58WW2
  ENSP ID: ENSP00000356814
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRFNIRGTTIGDRIMRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 22654 - protein, 880 aa, Homo sapiens
  Payload ID: 4560
  Gene Symbol: DCAF6
  Gene Name: DDB1 and CUL4 associated factor 6
  Uniprot ID: Q58WW2
  ENSP ID: ENSP00000356817
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 22655 - protein, 920 aa, Homo sapiens
  Payload ID: 4560
  Gene Symbol: DCAF6
  Gene Name: DDB1 and CUL4 associated factor 6
  Uniprot ID: Q58WW2
  ENSP ID: ENSP00000396238
MSRGGSYPHLLWDVRKRSLGLEDPSRLRSRYLGRREFIQRLKLEATLNVHDGCVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSEFLRGPEIALLRKRLQQLRLKKAEQQRQQELAAHTQQQPSTSDQSSHEGSSQDPHASDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRFNIRGTTIGDRIMRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 22656 - protein, 472 aa, Homo sapiens
  Payload ID: 4560
  Gene Symbol: DCAF6
  Gene Name: DDB1 and CUL4 associated factor 6
  ENSP ID: ENSP00000432304
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSGPLKSWVAGSCSE

SEQ ID NO: 22657 - protein, 342 aa, Homo sapiens
  Payload ID: 4561
  Gene Symbol: DCAF7
  Gene Name: DDB1 and CUL4 associated factor 7
  Uniprot ID: P61962
  ENSP ID: ENSP00000402312
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 22658 - protein, 142 aa, Homo sapiens
  Payload ID: 4561
  Gene Symbol: DCAF7
  Gene Name: DDB1 and CUL4 associated factor 7
  Uniprot ID: P61962
  ENSP ID: ENSP00000403920
MSLHGKRKEIYKYEAPWTVYAMNWSVRPDKRFRLALGSFVEEYNNKVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 22659 - protein, 206 aa, Homo sapiens
  Payload ID: 4561
  Gene Symbol: DCAF7
  Gene Name: DDB1 and CUL4 associated factor 7
  ENSP ID: ENSP00000480250
MSLHGKRKEIYKYEAPWTVYAMNWSVRPDKRFRLALGSFVEEYNNKVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPV

SEQ ID NO: 22660 - protein, 342 aa, Homo sapiens; identical to SEQ ID NO: 22657
  Payload ID: 4561
  Gene Symbol: DCAF7
  Gene Name: DDB1 and CUL4 associated factor 7
  Uniprot ID: P61962
  ENSP ID: ENSP00000483236

SEQ ID NO: 22661 - protein, 597 aa, Homo sapiens
  Payload ID: 4562
  Gene Symbol: DCAF8
  Gene Name: DDB1 and CUL4 associated factor 8
  Uniprot ID: Q5TAQ9
  ENSP ID: ENSP00000318227
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 22662 - protein, 597 aa, Homo sapiens; identical to SEQ ID NO: 22661
  Payload ID: 4562
  Gene Symbol: DCAF8
  Gene Name: DDB1 and CUL4 associated factor 8
  Uniprot ID: Q5TAQ9
  ENSP ID: ENSP00000357052

SEQ ID NO: 22663 - protein, 597 aa, Homo sapiens; identical to SEQ ID NO: 22661
  Payload ID: 4562
  Gene Symbol: DCAF8
  Gene Name: DDB1 and CUL4 associated factor 8
  Uniprot ID: Q5TAQ9
  ENSP ID: ENSP00000357053

SEQ ID NO: 22664 - protein, 106 aa, Homo sapiens
  Payload ID: 4562
  Gene Symbol: DCAF8
  Gene Name: DDB1 and CUL4 associated factor 8
  ENSP ID: ENSP00000384118
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEE

SEQ ID NO: 22665 - protein, 40 aa, Homo sapiens
  Payload ID: 4562
  Gene Symbol: DCAF8
  Gene Name: DDB1 and CUL4 associated factor 8
  ENSP ID: ENSP00000409434
MSSKGSSTDGRTDLANGSLSSSPEEMSGAEEGRETSSGIE

SEQ ID NO: 22666 - protein, 109 aa, Homo sapiens
  Payload ID: 4562
  Gene Symbol: DCAF8
  Gene Name: DDB1 and CUL4 associated factor 8
  ENSP ID: ENSP00000411875
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEE

SEQ ID NO: 22667 - protein, 212 aa, Homo sapiens
  Payload ID: 4562
  Gene Symbol: DCAF8
  Gene Name: DDB1 and CUL4 associated factor 8
  ENSP ID: ENSP00000413688
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGS

SEQ ID NO: 22668 - protein, 273 aa, Homo sapiens
  Payload ID: 4562
  Gene Symbol: DCAF8
  Gene Name: DDB1 and CUL4 associated factor 8
  Uniprot ID: Q5TAQ9
  ENSP ID: ENSP00000476351
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQVRQGSIIATERIRHELEKSELQHGLGADSELL

SEQ ID NO: 22669 - protein, 417 aa, Homo sapiens
  Payload ID: 4562
  Gene Symbol: DCAF8
  Gene Name: DDB1 and CUL4 associated factor 8
  ENSP ID: ENSP00000476407
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLSSWPVTMMKTFTSSTPLTVMGPSMLRDTRATEIMPQ

SEQ ID NO: 22670 - protein, 81 aa, Homo sapiens
  Payload ID: 4562
  Gene Symbol: DCAF8
  Gene Name: DDB1 and CUL4 associated factor 8
  ENSP ID: ENSP00000476539
  MOD_RES (1)..(1): Any amino acid
XLKDVIKKNKRERDEDSLHQTDLFDSHMLWFLMHHLRQRRHHRRWREPGVGATDADSDESPSSSDTSDEEEGPDRVQCMPS

SEQ ID NO: 22671 - protein, 125 aa, Homo sapiens
  Payload ID: 4562
  Gene Symbol: DCAF8
  Gene Name: DDB1 and CUL4 associated factor 8
  ENSP ID: ENSP00000477012
MSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRP

SEQ ID NO: 22672 - protein, 109 aa, Homo sapiens
  Payload ID: 4562
  Gene Symbol: DCAF8
  Gene Name: DDB1 and CUL4 associated factor 8
  ENSP ID: ENSP00000477255
  MOD_RES (1)..(1): Any amino acid
XEDIYLFNSSHSDGAQYVKRYKGHRNNATVKGVNFYGPKSEFVVSGSDCGHIFLWEKSSCQIIQFMEGDKGGVRDAGLNALSQASICPFSKSILQASLLLAQPMPGFDD

SEQ ID NO: 22673 - protein, 66 aa, Homo sapiens
  Payload ID: 4562
  Gene Symbol: DCAF8
  Gene Name: DDB1 and CUL4 associated factor 8
  ENSP ID: ENSP00000477386
RYKGHRNNATVKGVNFYGPKSEFVVSGSDCGHIFLWEKSSCQIIQFMEGDKGGWEEVGGGAEVKEE

SEQ ID NO: 22674 - protein, 273 aa, Homo sapiens; identical to SEQ ID NO: 22668
  Payload ID: 4562
  Gene Symbol: DCAF8
  Gene Name: DDB1 and CUL4 associated factor 8
  Uniprot ID: Q5TAQ9
  ENSP ID: ENSP00000477464

SEQ ID NO: 22675 - protein, 600 aa, Homo sapiens
  Payload ID: 4563
  Gene Symbol: DCAF8L1
  Gene Name: DDB1 and CUL4 associated factor 8-like 1
  Uniprot ID: A6NGE4
  ENSP ID: ENSP00000405222
MSHQEGSTGGLPDLVTESLFSSPEEQSGVAAVTAASSDIEMAATEPSTGDGGDTRDGGFLNDASTENQNTDSESSSEDVELESMGEGLFGYPLVGEETEREEEEEEMEEEGEEEEQPRMCPRCGGTNHDQCLLDEDQALEEWISSETSALPRSRWQVLTALRQRQLGSSARFVYEACGARTFVQRFRLQYLLGSHAGSVSTIHFNQRGTRLASSGDDLRVIVWDWVRQKPVLNFESGHDINVIQAKFFPNCGDSTLAMCGHDGQVRVAELINASYCENTKRVAKHRGPAHELALEPDSPYKFLTSGEDAVVFTIDLRQDRPASKVVVTRENDKKVGLYTISMNPANIYQFAVGGHDQFVRIYDQRRIDKKENNGVLKKFTPHHLVYCDFPTNITCVVYSHDGTELLASYNDEDIYLFNSSLSDGAQYVKRYKGHRNNDTIKCVNFYGPRSEFVVSGSDCGHVFFWEKSSSQIIQFMEGDRGDIVNCLEPHPYLPVLATSGLDQHVRIWTPTAKTATELTGLKDVIKKNKQERDEDNLNYTDSFDNRMLRFFVRHLLQRAHQPGWRDHGAEFPDEEELDESSSTSDTSEEEGQDRVQCIPS

SEQ ID NO: 22676 - protein, 631 aa, Homo sapiens
  Payload ID: 4564
  Gene Symbol: DCAF8L2
  Gene Name: DDB1 and CUL4 associated factor 8-like 2
  Uniprot ID: P0C7V8
  ENSP ID: ENSP00000462745
MSHQEGSTDGLPDLGTESLFSSPEEQSGAVAATEASSDIDIATSELSVTVTGDGSDSRDGGFPNDASTENRSSDQESASEDIELESLEDFEHFLMSGESLFHYPLVGEEETEREEEDEEIQEEGGEEEEEEEEEEEEEEEEEEEEEEQPRAGPQGSGGNHEQYSLEEDQALEEWVSSETSALPRPRWQVVTALHQRQLGSRPRFVYEACGARAFVQRFRLQYRLADHVGCVNTVHFNQRGTRLASSGDDLKVIVWDWVRQRPVLNFESGHTNNVFQAKFLPNCGDSTLAMCARDGQVRVAELINASYFNNTKCVAQHRGPAHKLALEPDSPYKFLTSGEDAVVFTIDLRQDRPASKVVVTRENDKKVGLYTITVNPANTYQFAVGGQDQFVRIYDQRKIDKKENNGVLKKFTPHHLVNCDFPTNITCVVYSHDGTELLASYNDDDIYLFNSSHSDGAQYSKRFKGHRNNTTVKGVNFYGPRSEFVVSGSDCGHIFFWEKSSCQIIQFLKGSREGTINCLEPHPYLPVLACSGLDHDVKIWTPTAKAATELTGLKKVIKKNKWERDEDSLHHGSLFDQYMLWFLLRHVTQRGRHQDWRSGEAEFPDEESDESSSTSETSEEEVQDRVQCMPS

SEQ ID NO: 22677 - protein, 29 aa, Homo sapiens
  Payload ID: 4564
  Gene Symbol: DCAF8L2
  Gene Name: DDB1 and CUL4 associated factor 8-like 2
  ENSP ID: ENSP00000464235
MSHQEGSTDGLPDLGTESLFSSPEEQSGA

SEQ ID NO: 22678 - protein, 631 aa, Homo sapiens; identical to SEQ ID NO: 22676
  Payload ID: 4564
  Gene Symbol: DCAF8L2
  Gene Name: DDB1 and CUL4 associated factor 8-like 2
  Uniprot ID: P0C7V8
  ENSP ID: ENSP00000479800

SEQ ID NO: 22679 - protein, 900 aa, Homo sapiens
  Payload ID: 4565
  Gene Symbol: DDHD1
  Gene Name: DDHD domain containing 1
  Uniprot ID: Q8NEL9
  ENSP ID: ENSP00000327104
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 22680 - protein, 872 aa, Homo sapiens
  Payload ID: 4565
  Gene Symbol: DDHD1
  Gene Name: DDHD domain containing 1
  Uniprot ID: Q8NEL9
  ENSP ID: ENSP00000350401
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 22681 - protein, 879 aa, Homo sapiens
  Payload ID: 4565
  Gene Symbol: DDHD1
  Gene Name: DDHD domain containing 1
  Uniprot ID: Q8NEL9
  ENSP ID: ENSP00000378970
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDGSGINYSAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 22682 - protein, 92 aa, Homo sapiens
  Payload ID: 4565
  Gene Symbol: DDHD1
  Gene Name: DDHD domain containing 1
  ENSP ID: ENSP00000450785
MRGQWFIDGTWQPLEEEESNLIEQEHLNCFRGQQMQENFDIEVSKSIDGKDAVHSFKLSRNHVDWHSVDEVYLYSDATTSKIARTVTQKLGF

SEQ ID NO: 22683 - protein, 771 aa, Homo sapiens
  Payload ID: 4565
  Gene Symbol: DDHD1
  Gene Name: DDHD domain containing 1
  ENSP ID: ENSP00000483405
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 22684 - protein, 711 aa, Homo sapiens
  Payload ID: 4566
  Gene Symbol: DDHD2
  Gene Name: DDHD domain containing 2
  Uniprot ID: O94830
  ENSP ID: ENSP00000380352
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 22685 - protein, 330 aa, Homo sapiens
  Payload ID: 4566
  Gene Symbol: DDHD2
  Gene Name: DDHD domain containing 2
  Uniprot ID: O94830
  ENSP ID: ENSP00000429017
MDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 22686 - protein, 711 aa, Homo sapiens; identical to SEQ ID NO: 22684
  Payload ID: 4566
  Gene Symbol: DDHD2
  Gene Name: DDHD domain containing 2
  Uniprot ID: O94830
  ENSP ID: ENSP00000429932

SEQ ID NO: 22687 - protein, 162 aa, Homo sapiens
  Payload ID: 4566
  Gene Symbol: DDHD2
  Gene Name: DDHD domain containing 2
  ENSP ID: ENSP00000431638
MVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 22688 - protein, 142 aa, Homo sapiens
  Payload ID: 4566
  Gene Symbol: DDHD2
  Gene Name: DDHD domain containing 2
  ENSP ID: ENSP00000432024
MDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKENLYK

SEQ ID NO: 22689 - protein, 156 aa, Homo sapiens
  Payload ID: 4566
  Gene Symbol: DDHD2
  Gene Name: DDHD domain containing 2
  ENSP ID: ENSP00000432433
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESP

SEQ ID NO: 22690 - protein, 137 aa, Homo sapiens
  Payload ID: 4566
  Gene Symbol: DDHD2
  Gene Name: DDHD domain containing 2
  ENSP ID: ENSP00000432678
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLE

SEQ ID NO: 22691 - protein, 161 aa, Homo sapiens
  Payload ID: 4566
  Gene Symbol: DDHD2
  Gene Name: DDHD domain containing 2
  ENSP ID: ENSP00000433118
MSSVQSQQEQLSQSDPSPSPNSCSSFELIDMDAGSLYEPVSPHWFYCKIIDSKETWIPFNSEDSQQLEEAYSSGCNGRVVPTDGGRYDVHLGERMRYAVYWDELASEVRRCTWFYKGDKDNKYVPYSESFSQVLEETYMLAVTLDEWKKKLESPNREIIIL

SEQ ID NO: 22692 - protein, 222 aa, Homo sapiens
  Payload ID: 4566
  Gene Symbol: DDHD2
  Gene Name: DDHD domain containing 2
  ENSP ID: ENSP00000433578
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCVNDFRSVSLNLLQTH

SEQ ID NO: 22693 - protein, 79 aa, Homo sapiens
  Payload ID: 4566
  Gene Symbol: DDHD2
  Gene Name: DDHD domain containing 2
  ENSP ID: ENSP00000435040
NTEETSVAVKEEVLPINVGMLNGGQRIDYVLQEKPIESFNEYLFALQSHLCYWESEDTVLLVLKEIYQTQGIFLDQPLQ

SEQ ID NO: 22694 - protein, 57 aa, Homo sapiens
  Payload ID: 4566
  Gene Symbol: DDHD2
  Gene Name: DDHD domain containing 2
  ENSP ID: ENSP00000436444
MRYAVYWDELASEVRRCTWFYKGDKDNKYVPYSESFSQVLEETYMLAVTLDEWKKKL

SEQ ID NO: 22695 - protein, 83 aa, Homo sapiens
  Payload ID: 4566
  Gene Symbol: DDHD2
  Gene Name: DDHD domain containing 2
  ENSP ID: ENSP00000436994
MSSVQSQQEQLSQSDPSPSPNSCSSFELIDMDAGSLYEPVSPHWFYCKIIDSKETWIPFNSEDSQQLEEAYSSGNLHACCNFG

SEQ ID NO: 22696 - protein, 213 aa, Homo sapiens
  Payload ID: 4566
  Gene Symbol: DDHD2
  Gene Name: DDHD domain containing 2
  ENSP ID: ENSP00000437029
  MOD_RES (1)..(1): Any amino acid
XEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 22697 - protein, 183 aa, Homo sapiens
  Payload ID: 4566
  Gene Symbol: DDHD2
  Gene Name: DDHD domain containing 2
  ENSP ID: ENSP00000437097
  MOD_RES (1)..(1): Any amino acid
XEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKGIKRPAPQPASGANI

SEQ ID NO: 22698 - protein, 118 aa, Homo sapiens
  Payload ID: 4567
  Gene Symbol: DDT
  Gene Name: D-dopachrome tautomerase
  Uniprot ID: P30046
  ENSP ID: ENSP00000215773
MPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 22699 - protein, 118 aa, Homo sapiens; identical to SEQ ID NO: 22698
  Payload ID: 4567
  Gene Symbol: DDT
  Gene Name: D-dopachrome tautomerase
  Uniprot ID: P30046
  ENSP ID: ENSP00000381386

SEQ ID NO: 22700 - protein, 166 aa, Homo sapiens
  Payload ID: 4567
  Gene Symbol: DDT
  Gene Name: D-dopachrome tautomerase
  ENSP ID: ENSP00000384866
MPFLELDTNLPANRVPAGLEKRLCAAAASILGKPADRVNVTVRPGLAMALSGSTEPCAQLSISSIGVVGTAEDNRSHSAHFFEFLTKELALGQDRFQVKFTGDSQSSERPLAWMSRHLLSGSCIAGGPQTNLEMNHLQLATSSSVNTGEKTSLPHKKRLQPKPGVL

SEQ ID NO: 22701 - protein, 132 aa, Homo sapiens
  Payload ID: 4567
  Gene Symbol: DDT
  Gene Name: D-dopachrome tautomerase
  ENSP ID: ENSP00000385714
MQLFLLAVSVPLPAMPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 22702 - protein, 107 aa, Homo sapiens
  Payload ID: 4567
  Gene Symbol: DDT
  Gene Name: D-dopachrome tautomerase
  Uniprot ID: P30046
  ENSP ID: ENSP00000399768
MPFLELDTNLPANRVPAGLEKRLCAAAASILGKPADRVNVTVRPGLAMALSGSTEPCAQLSISSIGVVGTAEDNRSHSAHFFEFLTKELALGQDRQVPGEVHGRLTE

SEQ ID NO: 22703 - protein, 50 aa, Homo sapiens
  Payload ID: 4567
  Gene Symbol: DDT
  Gene Name: D-dopachrome tautomerase
  ENSP ID: ENSP00000409440
  MOD_RES (1)..(1): Any amino acid
XKDLPPPQEASATQTWRSVTELKFPLGILIRFFPLESWQIGKIGTVMTFL

SEQ ID NO: 22704 - protein, 118 aa, Homo sapiens; identical to SEQ ID NO: 22698
  Payload ID: 4567
  Gene Symbol: DDT
  Gene Name: D-dopachrome tautomerase
  Uniprot ID: P30046
  ENSP ID: ENSP00000481175

SEQ ID NO: 22705 - protein, 166 aa, Homo sapiens; identical to SEQ ID NO: 22700
  Payload ID: 4567
  Gene Symbol: DDT
  Gene Name: D-dopachrome tautomerase
  ENSP ID: ENSP00000485690

SEQ ID NO: 22706 - protein, 107 aa, Homo sapiens; identical to SEQ ID NO: 22702
  Payload ID: 4567
  Gene Symbol: DDT
  Gene Name: D-dopachrome tautomerase
  Uniprot ID: P30046
  ENSP ID: ENSP00000486384

SEQ ID NO: 22707 - protein, 50 aa, Homo sapiens; identical to SEQ ID NO: 22703
  Payload ID: 4567
  Gene Symbol: DDT
  Gene Name: D-dopachrome tautomerase
  ENSP ID: ENSP00000486480
  MOD_RES (1)..(1): Any amino acid

SEQ ID NO: 22708 - protein, 118 aa, Homo sapiens; identical to SEQ ID NO: 22698
  Payload ID: 4567
  Gene Symbol: DDT
  Gene Name: D-dopachrome tautomerase
  Uniprot ID: P30046
  ENSP ID: ENSP00000486829

SEQ ID NO: 22709 - protein, 132 aa, Homo sapiens; identical to SEQ ID NO: 22701
  Payload ID: 4567
  Gene Symbol: DDT
  Gene Name: D-dopachrome tautomerase
  ENSP ID: ENSP00000486856

SEQ ID NO: 22710 - protein, 134 aa, Homo sapiens
  Payload ID: 4568
  Gene Symbol: DDTL
  Gene Name: D-dopachrome tautomerase-like
  Uniprot ID: A6NHG4
  ENSP ID: ENSP00000215770
MPFLELDTNLPANRVPAGLEKRLCAAAASILGKPADRVNVTVRPGLAMALSGSTEPCAQLSISSIGVVGTAEDNRSHSAHFFEFLTKELALGQDRFPTVLSTSPAAHGGPRCPGEIIEGKKSCLNEEALFIYFI

SEQ ID NO: 22711 - protein, 134 aa, Homo sapiens; identical to SEQ ID NO: 22710
  Payload ID: 4568
  Gene Symbol: DDTL
  Gene Name: D-dopachrome tautomerase-like
  Uniprot ID: A6NHG4
  ENSP ID: ENSP00000479063

SEQ ID NO: 22712 - protein, 314 aa, Homo sapiens
  Payload ID: 4569
  Gene Symbol: DDRGK1
  Gene Name: DDRGK domain containing 1
  Uniprot ID: Q96HY6
  ENSP ID: ENSP00000346483
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 22713 - protein, 298 aa, Homo sapiens
  Payload ID: 4569
  Gene Symbol: DDRGK1
  Gene Name: DDRGK domain containing 1
  ENSP ID: ENSP00000369548
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQVSPGTWPAVCSVARGLWLAERTCPKDRVLMHRLPCPQPRVSSAQKSPGTLGILHF

SEQ ID NO: 22714 - protein, 740 aa, Homo sapiens
  Payload ID: 4570
  Gene Symbol: DDX1
  Gene Name: DEAD (Asp-Glu-Ala-Asp) box helicase 1
  Uniprot ID: Q92499
  ENSP ID: ENSP00000233084
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 22715 - protein, 740 aa, Homo sapiens; identical to SEQ ID NO: 22714
  Payload ID: 4570
  Gene Symbol: DDX1
  Gene Name: DEAD (Asp-Glu-Ala-Asp) box helicase 1
  Uniprot ID: Q92499
  ENSP ID: ENSP00000370745

SEQ ID NO: 22716 - protein, 16 aa, Homo sapiens
  Payload ID: 4570
  Gene Symbol: DDX1
  Gene Name: DEAD (Asp-Glu-Ala-Asp) box helicase 1
  ENSP ID: ENSP00000413767
MAAFSEMGVMPEIAQA

SEQ ID NO: 22717 - protein, 659 aa, Homo sapiens [sequence omitted]

SEQ ID NO: 22718 - protein, 659 aa, Homo sapiens [sequence omitted]

SEQ ID NO: 22719 - protein, 731 aa, Homo sapiens
  Payload ID: 4571
  Gene Symbol: DDX17
  Gene Name: DEAD (Asp-Glu-Ala-Asp) box helicase 17
  ENSP ID: ENSP00000380033
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGKGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 22720 - protein, 729 aa, Homo sapiens
  Payload ID: 4571
  Gene Symbol: DDX17
  Gene Name: DEAD (Asp-Glu-Ala-Asp) box helicase 17
  Uniprot ID: Q92841
  ENSP ID: ENSP00000385536
LPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 22721 - protein, 56 aa, Homo sapiens
  Payload ID: 4571
  Gene Symbol: DDX17
  Gene Name: DEAD (Asp-Glu-Ala-Asp) box helicase 17
  ENSP ID: ENSP00000489029
  MOD_RES (1)..(1): Any amino acid
XWPAMCIHGDKSQPERDWVLNEFRSGKAPILIATDVASRGLGSPALGNQMGLQRSI

SEQ ID NO: 22722 - protein, 783 aa, Homo sapiens
  Payload ID: 4572
  Gene Symbol: DDX21
  Gene Name: DEAD (Asp-Glu-Ala-Asp) box helicase 21
  Uniprot ID: Q9NR30
  ENSP ID: ENSP00000346120
MPGKLRSDAGLESDTAMKKGETLRKQTEEKEKKEKPKSDKTEEIAEEEETVFPKAKQVKKKAEPSEVDMNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 22723 - protein, 715 aa, Homo sapiens
  Payload ID: 4572
  Gene Symbol: DDX21
  Gene Name: DEAD (Asp-Glu-Ala-Asp) box helicase 21
  Uniprot ID: Q9NR30
  ENSP ID: ENSP00000480334
MNSPKSKKAKKKEEPSQNDISPKTKSLRKKKEPIEKKVVSSKTKKVTKNEEPSEEEIDAPKPKKMKKEKEMNGETREKSPKLKNGFPHPEPDCNPSEAASEESNSEIEQEIPVEQKEGAFSNFPISEETIKLLKGRGVTFLFPIQAKTFHHVYSGKDLIAQARTGTGKTFSFAIPLIEKLHGELQDRKRGRAPQVLVLAPTRELANQVSKDFSDITKKLSVACFYGGTPYGGQFERMRNGIDILVGTPGRIKDHIQNGKLDLTKLKHVVLDEVDQMLDMGFADQVEEILSVAYKKDSEDNPQTLLFSATCPHWVFNVAKKYMKSTYEQVDLIGKKTQKTAITVEHLAIKCHWTQRAAVIGDVIRVYSGHQGRTIIFCETKKEAQELSQNSAIKQDAQSLHGDIPQKQREITLKGFRNGSFGVLVATNVAARGLDIPEVDLVIQSSPPKDVESYIHRSGRTGRAGRTGVCICFYQHKEEYQLVQVEQKAGIKFKRIGVPSATEIIKASSKDAIRLLDSVPPTAISHFKQSAEKLIEEKGAVEALAAALAHISGATSVDQRSLINSNVGFVTMILQCSIEMPNISYAWKELKEQLGEEIDSKVKGMVFLKGKLGVCFDVPTASVTEIQEKWHDSRRWQLSVATEQPELEGPREGYGGFRGQREGSRGFRGQRDGNRRFRGQREGSRGPRGQRSGGGNKSNRSQNKGQKRSFSKAFGQ

SEQ ID NO: 22724 - protein, 804 aa, Homo sapiens
  Payload ID: 4573
  Gene Symbol: DDX24
  Gene Name: DEAD (Asp-Glu-Ala-Asp) box helicase 24
  Uniprot ID: Q9GZR7
  ENSP ID: ENSP00000328690
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 22725 - protein, 609 aa, Homo sapiens
  Payload ID: 4573
  Gene Symbol: DDX24
  Gene Name: DEAD (Asp-Glu-Ala-Asp) box helicase 24
  ENSP ID: ENSP00000440623
MIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 22726 - protein, 816 aa, Homo sapiens
  Payload ID: 4573
  Gene Symbol: DDX24
  Gene Name: DEAD (Asp-Glu-Ala-Asp) box helicase 24
  ENSP ID: ENSP00000452145
MDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 22727 - protein, 804 aa, Homo sapiens; identical to SEQ ID NO: 22724
  Payload ID: 4573
  Gene Symbol: DDX24
  Gene Name: DEAD (Asp-Glu-Ala-Asp) box helicase 24
  Uniprot ID: Q9GZR7
  ENSP ID: ENSP00000478630

SEQ ID NO: 22728 - protein, 816 aa, Homo sapiens; identical to SEQ ID NO: 22726
  Payload ID: 4573
  Gene Symbol: DDX24
  Gene Name: DEAD (Asp-Glu-Ala-Asp) box helicase 24
  ENSP ID: ENSP00000480033

SEQ ID NO: 22729 - protein, 485 aa, Homo sapiens
  Payload ID: 4573
  Gene Symbol: DDX24
  Gene Name: DEAD (Asp-Glu-Ala-Asp) box helicase 24
  ENSP ID: ENSP00000481317
MTKAPCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 22730 - protein, 859 aa, Homo sapiens
  Payload ID: 4573
  Gene Symbol: DDX24
  Gene Name: DEAD (Asp-Glu-Ala-Asp) box helicase 24
  Uniprot ID: Q9GZR7
  ENSP ID: ENSP00000481495
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTSTQKEFEVKDPELEAQGDDMVCDDPEAGEMTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGETRTEAGAETRSPGKAEAESDALPDDTVIESEALPSDIAAEARAKTGGTVSDQALLFGDDDAGEGPSSLIREKPVPKQNENEEENLDKEQTGNLKQELDDKSATCKAYPKRPLLGLVLTPTRELAVQVKQHIDAVARFTGIKTAILVGGMSTQKQQRMLNRRPEIVVATPGRLWELIKEKHYHLRNLRQLRCLVVDEADRMVEKGHFAELSQLLEMLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKTLKKDEDIPLFPVQTKYMDVVKERIRLARQIEKSEYRNFQACLHNSWIEQAAAALEIELEEDMYKGGKADQQEERRRQKQMKVLKKELRHLLSQPLFTESQKTKYPTQSGKPPLLVSAPSKSESALSCLSKQKKKKTKKPKEPQPEQPQPSTSAN

SEQ ID NO: 22731 - protein, 859 aa, Homo sapiens; identical to SEQ ID NO: 22730
  Payload ID: 4573
  Gene Symbol: DDX24
  Gene Name: DEAD (Asp-Glu-Ala-Asp) box helicase 24
  Uniprot ID: Q9GZR7
  ENSP ID: ENSP00000482106

SEQ ID NO: 22732 - protein, 485 aa, Homo sapiens; identical to SEQ ID NO: 22729
  Payload ID: 4573
  Gene Symbol: DDX24
  Gene Name: DEAD (Asp-Glu-Ala-Asp) box helicase 24
  ENSP ID: ENSP00000484301

SEQ ID NO: 22733 - protein, 609 aa, Homo sapiens; identical to SEQ ID NO: 22725
  Payload ID: 4573
  Gene Symbol: DDX24
  Gene Name: DEAD (Asp-Glu-Ala-Asp) box helicase 24
  ENSP ID: ENSP00000486353

SEQ ID NO: 22734 - protein, 483 aa, Homo sapiens
  Payload ID: 4574
  Gene Symbol: DDX25
  Gene Name: DEAD (Asp-Glu-Ala-Asp) box helicase 25
  Uniprot ID: Q9UHL0
  ENSP ID: ENSP00000263576
MASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 22735 - protein, 191 aa, Homo sapiens
  Payload ID: 4574
  Gene Symbol: DDX25
  Gene Name: DEAD (Asp-Glu-Ala-Asp) box helicase 25
  ENSP ID: ENSP00000432800
ASVRSGASDAGGEMREGFGRGPQRETPSPPPREFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYEL

SEQ ID NO: 22736 - protein, 407 aa, Homo sapiens
  Payload ID: 4574
  Gene Symbol: DDX25
  Gene Name: DEAD (Asp-Glu-Ala-Asp) box helicase 25
  ENSP ID: ENSP00000436087
  MOD_RES (1)..(1): Any amino acid
XLVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRNWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 22737 - protein, 468 aa, Homo sapiens
  Payload ID: 4574
  Gene Symbol: DDX25
  Gene Name: DEAD (Asp-Glu-Ala-Asp) box helicase 25
  ENSP ID: ENSP00000463333
IAAMASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFSK

SEQ ID NO: 22738 - protein, 67 aa, Homo sapiens
  Payload ID: 4574
  Gene Symbol: DDX25
  Gene Name: DEAD (Asp-Glu-Ala-Asp) box helicase 25
  ENSP ID: ENSP00000464251
  MOD_RES (1)..(1): Any amino acid
XGIDVKQVTIVVNFDLPVKQGEEPDYETYLHRIGRTGRFGKKGLAFNMIEVDELPSLMKIQDHFRKS

SEQ ID NO: 22739 - protein, 662 aa, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000382840
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 22740 - protein, 646 aa, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000392494
MSHVAVENALGLDQQFAGLDLNSSDNQSGGSTASSFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGGYGGFYNSDGYGGNYNSQGVDWWGN

SEQ ID NO: 22741 - protein, 139 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000414281
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGYGGFYNSDGYGGNYNSQGVDWWGN

SEQ ID NO: 22742 - protein, 662 aa, Homo sapiens; identical to SEQ ID NO: 22739
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000478443

SEQ ID NO: 22743 - protein, 138 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000479790
  MOD_RES (1)..(1): Any amino acid
XDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGSSRSQEEMKGTISSPVQKVV

SEQ ID NO: 22744 - protein, 98 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000480647
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGSVVN

SEQ ID NO: 22745 - protein, 733 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000486306
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGSSRSQEEMKGTISSPVQKDHAPLWSKCLHEMPYFVKKVHAGIFRSPACSHGSLRYLRPTNPPDEDNHNSCRHESNLERDAQKCVNWSVTTKMRTAC

SEQ ID NO: 22746 - protein, 640 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000486443
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGELGA

SEQ ID NO: 22747 - protein, 647 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000486514
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSSRFSGGFGARDYRQSSGASSSSFSSSRASSSRSGGGGHGSSRGFGGGSCSSVEQVPP

SEQ ID NO: 22748 - protein, 662 aa, Homo sapiens; identical to SEQ ID NO: 22739
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000486516

SEQ ID NO: 22749 - protein, 662 aa, Homo sapiens; identical to SEQ ID NO: 22739
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000486720

SEQ ID NO: 22750 - protein, 647 aa, Homo sapiens; identical to SEQ ID NO: 22747
  Payload ID: 4575
  Gene Symbol: DDX3X
  Gene Name: DEAD (Asp-Glu-Ala-Asp) box helicase 3, X-linked
  ENSP ID: ENSP00000487062

SEQ ID NO: 22751 - protein, 662 aa, Homo sapiens; identical to SEQ ID NO: 22739
  Payload ID: 4575
  Gene Symbol: DDX3X
  Gene Name: DEAD (Asp-Glu-Ala-Asp) box helicase 3, X-linked
  Uniprot ID: O00571
  ENSP ID: ENSP00000487224

SEQ ID NO: 22752 - protein, 164 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000487626
  MOD_RES (1)..(1): Any amino acid
XLHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSRFSGGFGARDYRQSSGASSSSFSSSRASSSRSGGGGHGSSRGFGGGSCSSVEQVPP

SEQ ID NO: 22753 - protein, 164 aa, Homo sapiens
  Payload ID: 4575
  Gene Symbol: DDX3X
  Gene Name: DEAD (Asp-Glu-Ala-Asp) box helicase 3, X-linked
  ENSP ID: ENSP00000488854
MSHVAVENALGLDQQFAGLDLNSSDNQSGGSTASSFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIE

SEQ ID NO: 22754 - protein, 660 aa, Homo sapiens
  Payload ID: 4576
  Gene Symbol: DDX3Y
  Gene Name: DEAD (Asp-Glu-Ala-Asp) box helicase 3, Y-linked
  Uniprot ID: O15523
  ENSP ID: ENSP00000336725
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 22755 - protein, 660 aa, Homo sapiens; identical to SEQ ID NO: 22754
  Payload ID: 4576
  Gene Symbol: DDX3Y
  Gene Name: DEAD (Asp-Glu-Ala-Asp) box helicase 3, Y-linked
  Uniprot ID: O15523
  ENSP ID: ENSP00000353284

SEQ ID NO: 22756 - protein, 224 aa, Homo sapiens
  Payload ID: 4576
  Gene Symbol: DDX3Y
  Gene Name: DEAD (Asp-Glu-Ala-Asp) box helicase 3, Y-linked
  ENSP ID: ENSP00000398953
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQT

SEQ ID NO: 22757 - protein, 250 aa, Homo sapiens
  Payload ID: 4576
  Gene Symbol: DDX3Y
  Gene Name: DEAD (Asp-Glu-Ala-Asp) box helicase 3, Y-linked
  ENSP ID: ENSP00000400377
MEIGRPRKDTWKLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVK

SEQ ID NO: 22758 - protein, 819 aa, Homo sapiens
  Payload ID: 4577
  Gene Symbol: DDX42
  Gene Name: DEAD (Asp-Glu-Ala-Asp) box helicase 42
  Uniprot ID: Q86XP3
  ENSP ID: ENSP00000352308
MAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 22759 - protein, 938 aa, Homo sapiens
  Payload ID: 4577
  Gene Symbol: DDX42
  Gene Name: DEAD (Asp-Glu-Ala-Asp) box helicase 42
  Uniprot ID: Q86XP3
  ENSP ID: ENSP00000374574
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSRHSHGETGNRHSDSPRHGDGGRHGDGYRHPESSSRHTDGHRHGENRHGGSAGRHGENRGANDGRNGESRKEAFNRESKMEPKMEPKVDSSKMDKVDSKTDKTADGFAVPEPPKRKKSRWDS

SEQ ID NO: 22760 - protein, 708 aa, Homo sapiens
  Payload ID: 4577
  Gene Symbol: DDX42
  Gene Name: DEAD (Asp-Glu-Ala-Asp) box helicase 42
  ENSP ID: ENSP00000390121
MAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSPSQSRRDWQSA

SEQ ID NO: 22761 - protein, 99 aa, Homo sapiens
  Payload ID: 4577
  Gene Symbol: DDX42
  Gene Name: DEAD (Asp-Glu-Ala-Asp) box helicase 42
  ENSP ID: ENSP00000461957
  MOD_RES (1)..(1): Any amino acid
XDPLEAFMAEVEDQAARDMKRLEEKDKERKNVKGIRDDIEEEDDQEAYFRYMAENPTAGVVQEEEEDNLEYDSDGNPIAPTKKIIDPLPPIDHSETNFE

SEQ ID NO: 22762 - protein, 70 aa, Homo sapiens
  Payload ID: 4577
  Gene Symbol: DDX42
  Gene Name: DEAD (Asp-Glu-Ala-Asp) box helicase 42
  ENSP ID: ENSP00000462174
  MOD_RES (1)..(1): Any amino acid
XQQFHSKPVDSDSDDDPLEAFMAEVEDQAARDMKRLEEKDKERKNVKKLIFDTWQKTQLLVWFRRKRKTI

SEQ ID NO: 22763 - protein, 159 aa, Homo sapiens
  Payload ID: 4577
  Gene Symbol: DDX42
  Gene Name: DEAD (Asp-Glu-Ala-Asp) box helicase 42
  ENSP ID: ENSP00000463038
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHSKPVDSDSDDDPLEAFMAEVEDQAARDMKRLEEKDKERKNVNVESSCAVWNSTLIC

SEQ ID NO: 22764 - protein, 938 aa, Homo sapiens; identical to SEQ ID NO: 22759
  Payload ID: 4577
  Gene Symbol: DDX42
  Gene Name: DEAD (Asp-Glu-Ala-Asp) box helicase 42
  Uniprot ID: Q86XP3
  ENSP ID: ENSP00000463561

SEQ ID NO: 22765 - protein, 938 aa, Homo sapiens; identical to SEQ ID NO: 22759
  Payload ID: 4577
  Gene Symbol: DDX42
  Gene Name: DEAD (Asp-Glu-Ala-Asp) box helicase 42
  Uniprot ID: Q86XP3
  ENSP ID: ENSP00000464050

SEQ ID NO: 22766 - protein, 104 aa, Homo sapiens
  Payload ID: 4577
  Gene Symbol: DDX42
  Gene Name: DEAD (Asp-Glu-Ala-Asp) box helicase 42
  ENSP ID: ENSP00000464232
MNWNKGGPGTKRGFGFGGFAISAGKKEEPKLPQQSHSAFGATSSSSGFGKSAPPQLPSFYKIGSKRANFDEENAYFEDEEEDSSNVDLPYIPAENSPTRQQFHS

SEQ ID NO: 22767 - protein, 614 aa, Homo sapiens
  Payload ID: 4578
  Gene Symbol: DDX5
  Gene Name: DEAD (Asp-Glu-Ala-Asp) box helicase 5
  Uniprot ID: P17844
  ENSP ID: ENSP00000225792
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 22768 - protein, 535 aa, Homo sapiens
  Payload ID: 4578
  Gene Symbol: DDX5
  Gene Name: DEAD (Asp-Glu-Ala-Asp) box helicase 5
  Uniprot ID: P17844
  ENSP ID: ENSP00000403085
MSGYSSDRDRGRDRGFGAPRFGGSRAGPLSGKKFGNPGEKLVKKKWNLDELPKFEKNFYQEHPDLARRTAQEVETYRRSKEITVRGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 22769 - protein, 96 aa, Homo sapiens
  Payload ID: 4578
  Gene Symbol: DDX5
  Gene Name: DEAD (Asp-Glu-Ala-Asp) box helicase 5
  ENSP ID: ENSP00000440276
MSGYSSDRDRGRDRGFGAPRFGGSRAGPLSGKKFGNPGEKLVKKKWNLDELPKFEKNFYQEHPDLARRTAQMSWMLLQDRISLNPLLFKLRDGQLL

SEQ ID NO: 22770 - protein, 120 aa, Homo sapiens
  Payload ID: 4578
  Gene Symbol: DDX5
  Gene Name: DEAD (Asp-Glu-Ala-Asp) box helicase 5
  ENSP ID: ENSP00000462206
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAI

SEQ ID NO: 22771 - protein, 166 aa, Homo sapiens
  Payload ID: 4578
  Gene Symbol: DDX5
  Gene Name: DEAD (Asp-Glu-Ala-Asp) box helicase 5
  ENSP ID: ENSP00000462222
ERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEK

SEQ ID NO: 22772 - protein, 614 aa, Homo sapiens
  Payload ID: 4578
  Gene Symbol: DDX5
  Gene Name: DEAD (Asp-Glu-Ala-Asp) box helicase 5
  ENSP ID: ENSP00000462885
MKAGRFEADEGTSVRFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 22773 - protein, 38 aa, Homo sapiens
  Payload ID: 4578
  Gene Symbol: DDX5
  Gene Name: DEAD (Asp-Glu-Ala-Asp) box helicase 5
  ENSP ID: ENSP00000463101
MDVIARQNFTEPTAIQAQGWPVALSGLDMVGVAQTGSG

SEQ ID NO: 22774 - protein, 44 aa, Homo sapiens
  Payload ID: 4578
  Gene Symbol: DDX5
  Gene Name: DEAD (Asp-Glu-Ala-Asp) box helicase 5
  ENSP ID: ENSP00000463168
MSGYSSDRDRGRDRGFGAPRFGGSRAGPLSGKKFGNPGEKLVKK

SEQ ID NO: 22775 - protein, 46 aa, Homo sapiens
  Payload ID: 4578
  Gene Symbol: DDX5
  Gene Name: DEAD (Asp-Glu-Ala-Asp) box helicase 5
  ENSP ID: ENSP00000463541
MDVIARQNFTEPTAIQAQGWPVALSGLDMVGVAQTGSGKTLSYLLP

SEQ ID NO: 22776 - protein, 10 aa, Homo sapiens
  Payload ID: 4578
  Gene Symbol: DDX5
  Gene Name: DEAD (Asp-Glu-Ala-Asp) box helicase 5
  ENSP ID: ENSP00000463903
MDVIARQNFT

SEQ ID NO: 22777 - protein, 99 aa, Homo sapiens
  Payload ID: 4578
  Gene Symbol: DDX5
  Gene Name: DEAD (Asp-Glu-Ala-Asp) box helicase 5
  ENSP ID: ENSP00000463975
MSGYSSDRDRGRDRGFGAPRFGGSRAGPLSGKKFGNPGEKLVKKKWNLDELPKFEKNFYQEHPDLARRTAQEVETYRRSKEITVRVWKNQSEKNNLPCP

SEQ ID NO: 22778 - protein, 52 aa, Homo sapiens
  Payload ID: 4578
  Gene Symbol: DDX5
  Gene Name: DEAD (Asp-Glu-Ala-Asp) box helicase 5
  ENSP ID: ENSP00000464064
MDVIARQNFTEPTAIQAQGWPVALSGLDMVGVAQTGSGKTLSYLLPAIVHIN

SEQ ID NO: 22779 - protein, 65 aa, Homo sapiens
  Payload ID: 4578
  Gene Symbol: DDX5
  Gene Name: DEAD (Asp-Glu-Ala-Asp) box helicase 5
  ENSP ID: ENSP00000464304
MDVIARQNFTEPTAIQAQGWPVALSGLDMVGVAQTGSGKTLSYLLPAIVHINHQPFLERGDGPIC

SEQ ID NO: 22780 - protein, 212 aa, Homo sapiens
  Payload ID: 4578
  Gene Symbol: DDX5
  Gene Name: DEAD (Asp-Glu-Ala-Asp) box helicase 5
  ENSP ID: ENSP00000464337
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIR

SEQ ID NO: 22781 - protein, 38 aa, Homo sapiens
  Payload ID: 4578
  Gene Symbol: DDX5
  Gene Name: DEAD (Asp-Glu-Ala-Asp) box helicase 5
  ENSP ID: ENSP00000464566
MSGYSSDRDRGRDRGKRWKHTEEARKLQLEVTTARSQF

SEQ ID NO: 22782 - protein, 31 aa, Homo sapiens
  Payload ID: 4578
  Gene Symbol: DDX5
  Gene Name: DEAD (Asp-Glu-Ala-Asp) box helicase 5
  ENSP ID: ENSP00000464587
MDVIARQNFTEPTAIQAQGWPVALSGLDMVG

SEQ ID NO: 22783 - protein, 153 aa, Homo sapiens
  Payload ID: 4578
  Gene Symbol: DDX5
  Gene Name: DEAD (Asp-Glu-Ala-Asp) box helicase 5
  ENSP ID: ENSP00000464659
  MOD_RES (1)..(1): Any amino acid
XRGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGYV

SEQ ID NO: 22784 - protein, 16 aa, Homo sapiens
  Payload ID: 4578
  Gene Symbol: DDX5
  Gene Name: DEAD (Asp-Glu-Ala-Asp) box helicase 5
  ENSP ID: ENSP00000465791
MDVIARQNFTEPTAIQ

SEQ ID NO: 22785 - protein, 99 aa, Homo sapiens; identical to SEQ ID NO: 22777
  Payload ID: 4578
  Gene Symbol: DDX5
  Gene Name: DEAD (Asp-Glu-Ala-Asp) box helicase 5
  ENSP ID: ENSP00000485764

SEQ ID NO: 22786 - protein, 547 aa, Homo sapiens
  Payload ID: 4579
  Gene Symbol: DDX56
  Gene Name: DEAD (Asp-Glu-Ala-Asp) box helicase 56
  Uniprot ID: Q9NY93
  ENSP ID: ENSP00000258772
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 22787 - protein, 103 aa, Homo sapiens
  Payload ID: 4579
  Gene Symbol: DDX56
  Gene Name: DEAD (Asp-Glu-Ala-Asp) box helicase 56
  ENSP ID: ENSP00000388310
MEDSEALGFEHMGLDPRLLQAVTDLGWSRPTLIQEKAIPLALEGKDLLARARTGSGKTAAYAIPMLQLLLHRKASCADGEARCGSRDPISHIKPLAARQPETS

SEQ ID NO: 22788 - protein, 182 aa, Homo sapiens
  Payload ID: 4579
  Gene Symbol: DDX56
  Gene Name: DEAD (Asp-Glu-Ala-Asp) box helicase 56
  ENSP ID: ENSP00000390553
HLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKVRLLGTADSPRTPPNLLFCHHQNVEAPCPREGKRGCPREGKRGHPRTGPQKSGVG

SEQ ID NO: 22789 - protein, 375 aa, Homo sapiens
  Payload ID: 4579
  Gene Symbol: DDX56
  Gene Name: DEAD (Asp-Glu-Ala-Asp) box helicase 56
  ENSP ID: ENSP00000392139
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGR

SEQ ID NO: 22790 - protein, 507 aa, Homo sapiens
  Payload ID: 4579
  Gene Symbol: DDX56
  Gene Name: DEAD (Asp-Glu-Ala-Asp) box helicase 56
  Uniprot ID: Q9NY93
  ENSP ID: ENSP00000393488
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 22791 - protein, 185 aa, Homo sapiens
  Payload ID: 4579
  Gene Symbol: DDX56
  Gene Name: DEAD (Asp-Glu-Ala-Asp) box helicase 56
  ENSP ID: ENSP00000402989
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLW

SEQ ID NO: 22792 - protein, 396 aa, Homo sapiens
  Payload ID: 4579
  Gene Symbol: DDX56
  Gene Name: DEAD (Asp-Glu-Ala-Asp) box helicase 56
  ENSP ID: ENSP00000411456
  MOD_RES (1)..(1): Any amino acid
XLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRCPPPGCHALSD

SEQ ID NO: 22793 - protein, 483 aa, Homo sapiens
  Payload ID: 4580
  Gene Symbol: DDX6
  Gene Name: DEAD (Asp-Glu-Ala-Asp) box helicase 6
  Uniprot ID: P26196
  ENSP ID: ENSP00000433704
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 22794 - protein, 483 aa, Homo sapiens; identical to SEQ ID NO: 22793
  Payload ID: 4580
  Gene Symbol: DDX6
  Gene Name: DEAD (Asp-Glu-Ala-Asp) box helicase 6
  Uniprot ID: P26196
  ENSP ID: ENSP00000442266

SEQ ID NO: 22795 - protein, 483 aa, Homo sapiens; identical to SEQ ID NO: 22793
  Payload ID: 4580
  Gene Symbol: DDX6
  Gene Name: DEAD (Asp-Glu-Ala-Asp) box helicase 6
  Uniprot ID: P26196
  ENSP ID: ENSP00000478754

SEQ ID NO: 22796 - protein, 187 aa, Homo sapiens [sequence omitted]

SEQ ID NO: 22797 - protein, 875 aa, Homo sapiens
  Payload ID: 4581
  Gene Symbol: DDX10
  Gene Name: DEAD (Asp-Glu-Ala-Asp) box polypeptide 10
  Uniprot ID: Q13206
  ENSP ID: ENSP00000314348
MGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVLEALYRLQWTSTDGLGVLIISPTRELAYQTFEVLRKVGKNHDFSAGLIIGGKDLKHEAERINNINILVCTPGRLLQHMDETVSFHATDLQMLVLDEADRILDMGFADTMNAVIENLPKKRQTLLFSATQTKSVKDLARLSLKNPEYVWVHEKAKYSTPATLEQNYIVCELQQKISVLYSFLRSHLKKKSIVFFSSCKEVQYLYRVFCRLRPGVSILALHGRQQQMRRMEVYNEFVRKRAAVLFATDIAARGLDFPAVNWVLQFDCPEDANTYIHRAGRTARYKEDGEALLILLPSEKAMVQQLLQKKVPVKEIKINPEKLIDVQKKLESILAQDQDLKERAQRCFVSYVRSVYLMKDKEVFDVSKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKISDTKKKQGMKKRSNSEVEDVGPTSHNRKKARWDTLEPLDTGLSLAEDEELVLHLLRSQS

SEQ ID NO: 22798 - protein, 835 aa, Homo sapiens
  Payload ID: 4581
  Gene Symbol: DDX10
  Gene Name: DEAD (Asp-Glu-Ala-Asp) box polypeptide 10
  ENSP ID: ENSP00000432032
MGKTANSPGSGARPDPVRSFNRWKKKHSHRQNKKKQLRKQLKKPEWQVERESISRLMQNYEKINVNEITRFSDFPLSKKTLKGLQEAQYRLVTEIQKQTIGLALQGKDVLGAAKTGSGKTLAFLVPVLEALYRLQWTSTDGLGVLIISPTRELAYQTFEVLRKVGKNHDFSAGLIIGGKDLKHEAERINNINILVCTPGRLLQHMDETVSFHATDLQMLVLDEADRILDMGFADTMNAVIENLPKKRQTLLFSATQTKSVKDLARLSLKNPEYVWVHEKAKYSTPATLEQNYIVCELQQKISVLYSFLRSHLKKKSIVFFSSCKEVQYLYRVFCRLRPGVSILALHGRQQQMRRMEVYNEFVRKRAAVLFATDIAARGLDFPAVNWVLQFDCPEDANTYIHRAGRTARYKEDGEALLILLPSEKAMVQQLLQKKVPVKEIKINPEKLIDVQKKLESILAQDQDLKERAQRCFVSYVRSVYLMKDKEVFDVSKLPIPEYALSLGLAVAPRVRFLQKMQKQPTKELVRSQADKVIEPRAPSLTNDEVEEFRAYFNEKMSILQKGGKRLEGTEHRQDNDTGNEEQEEEEDDEEEMEEKLAKAKGSQAPSLPNTSEAQKIKEVPTQFLDRDEEEEDADFLKVKRHNVFGLDLKDEKTLQKKEPSKSSIKKKMTKVAEAKKVMKRNFKVNKKITFTDEGELVQQWPQMQKSAIKDAEEDDDTGGINLHKAKERLQEEDKFDKEEYRKKIKAKHREKRLKEREARREANKRQAKAKDEEEAFLDWSDDDDDDDDGFDPSTLPDPDKYRSSEDSDSEDMENKIRYVFTMGMKYILSTLTSVF

SEQ ID NO: 22799 - protein, 670 aa, Homo sapiens
  Payload ID: 4582
  Gene Symbol: DDX18
  Gene Name: DEAD (Asp-Glu-Ala-Asp) box polypeptide 18
  Uniprot ID: Q9NVP1
  ENSP ID: ENSP00000263239
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 22800 - protein, 214 aa, Homo sapiens
  Payload ID: 4582
  Gene Symbol: DDX18
  Gene Name: DEAD (Asp-Glu-Ala-Asp) box polypeptide 18
  ENSP ID: ENSP00000415604
NTPGFMYKNLQCLVIDEADRILDVGFEEELKQIIKLLPTRRQTMLFSATQTRKVEDLARISLKKEPLYVGVDDDKANATVDGLEQKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSE

SEQ ID NO: 22801 - protein, 478 aa, Homo sapiens
  Payload ID: 4583
  Gene Symbol: DDX19A
  Gene Name: DEAD (Asp-Glu-Ala-Asp) box polypeptide 19A
  Uniprot ID: Q9NUU7
  ENSP ID: ENSP00000306117
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22802 - protein, 447 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000410243
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22803 - protein, 47 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000455134
MATDSWALAVDEQEAAVKSVLSKPVPLPRKQMKRRKRTELPSPYSTS

SEQ ID NO: 22804 - protein, 51 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000455152
MATDSWALAVDEQEAAVKSRRGFSMLVRLVSNSRPQVIRPPRPPKVLGLQP

SEQ ID NO: 22805 - protein, 78 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000456765
MATDSWALAVDEQEAAVKSMTNLQIKEEKVKADTNGIIKTSTTAEKTDEEEKGNHSFSRESMPWASIDPPRYKRTHYP

SEQ ID NO: 22806 - protein, 129 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000457103
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEP

SEQ ID NO: 22807 - protein, 396 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000460180
  MOD_RES (1)..(1): Any amino acid
XWLTGDFWMSGTFLIRKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22808 - protein, 64 aa, Homo sapiens
  Payload ID: 4583
  Gene Symbol: DDX19A
  Gene Name: DEAD (Asp-Glu-Ala-Asp) box polypeptide 19A
  ENSP ID: ENSP00000464207
MATDSWALAVDEQEAAVKSMTNLQIKEEKVKADTNGIIKTSTTAEKTDEEEKVLTQQADQKQPC

SEQ ID NO: 22809 - protein, 479 aa, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000288071
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22810 - protein, 448 aa, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000348271
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22811 - protein, 370 aa, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000377267
MGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22812 - protein, 453 aa, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000392639
MAGAAGRVQDRALRRFPITLPVGDLSNLHLKEEKIKPDTNGAVVKTNANAEKTDEEEKEDRAAQSLLNKLIRSNLVDNTNQVEVLQRDPNSPLYSVKSFEELRLPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22813 - protein, 233 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000454495
MQLREKLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADV

SEQ ID NO: 22814 - protein, 32 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000454571
MATDSWALAVDEQEAAAESPTELNCPISVWYW

SEQ ID NO: 22815 - protein, 30 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000455193
MATDSWALAVDEQEAAAESRTELPSPYSTS

SEQ ID NO: 22816 - protein, 484 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000455813
MAGAAGRVQDRALRRFPITLPVGDLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 22817 - protein, 370 aa, Homo sapiens; identical to SEQ ID NO: 22811
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000456574

SEQ ID NO: 22818 - protein, 370 aa, Homo sapiens; identical to SEQ ID NO: 22811
  Payload ID: 4584
  Gene Symbol: DDX19B
  Gene Name: DEAD (Asp-Glu-Ala-Asp) box polypeptide 19B
  Uniprot ID: Q9UMR2
  ENSP ID: ENSP00000456757

SEQ ID NO: 22819 - protein, 41 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000457366
MATDSWALAVDEQEAAAESLSNLHLKEEKIKPDTNGLYKNF

SEQ ID NO: 22820 - protein, 48 aa, Homo sapiens
  Payload ID: 4584
  Gene Symbol: DDX19B
  Gene Name: DEAD (Asp-Glu-Ala-Asp) box polypeptide 19B
  ENSP ID: ENSP00000457633
MATDSWALAVDEQEAAAESVLLSRPMPMQRRQMKKRKRTELPSPYSTS

SEQ ID NO: 22821 - protein, 48 aa, Homo sapiens; identical to SEQ ID NO: 22820
  Payload ID: 4584
  Gene Symbol: DDX19B
  Gene Name: DEAD (Asp-Glu-Ala-Asp) box polypeptide 19B
  ENSP ID: ENSP00000459407

SEQ ID NO: 22822 - protein, 824 aa, Homo sapiens
  Payload ID: 4585
  Gene Symbol: DDX20
  Gene Name: DEAD (Asp-Glu-Ala-Asp) box polypeptide 20
  Uniprot ID: Q9UHI6
  ENSP ID: ENSP00000358716
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQRVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 22823 - protein, 138 aa, Homo sapiens
  Payload ID: 4585
  Gene Symbol: DDX20
  Gene Name: DEAD (Asp-Glu-Ala-Asp) box polypeptide 20
  Uniprot ID: Q9UHI6
  ENSP ID: ENSP00000434085
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQAELSNS

SEQ ID NO: 22824 - protein, 432 aa, Homo sapiens [sequence omitted]

SEQ ID NO: 22825 - protein, 820 aa, Homo sapiens
  Payload ID: 4586
  Gene Symbol: DDX23
  Gene Name: DEAD (Asp-Glu-Ala-Asp) box polypeptide 23
  Uniprot ID: Q9BUQ8
  ENSP ID: ENSP00000310723
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 22826 - protein, 108 aa, Homo sapiens
  Payload ID: 4586
  Gene Symbol: DDX23
  Gene Name: DEAD (Asp-Glu-Ala-Asp) box polypeptide 23
  Uniprot ID: Q9BUQ8
  ENSP ID: ENSP00000446770
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSRH

SEQ ID NO: 22827 - protein, 138 aa, Homo sapiens
  Payload ID: 4586
  Gene Symbol: DDX23
  Gene Name: DEAD (Asp-Glu-Ala-Asp) box polypeptide 23
  ENSP ID: ENSP00000446948
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPK

SEQ ID NO: 22828 - protein, 152 aa, Homo sapiens
  Payload ID: 4586
  Gene Symbol: DDX23
  Gene Name: DEAD (Asp-Glu-Ala-Asp) box polypeptide 23
  ENSP ID: ENSP00000448542
  MOD_RES (1)..(1): Any amino acid
XDYSITTKGGKIPNPIRSWKDSSLPPHILEVIDKCGYKEPTPIQRQAIPIGLQNRDIIGVAETGSGKTAAFLIPLLVWITTLPKIDRLECSGVILAYSNRCLPGSYPPTSASQVAGITGSKSQTKALMPSSWLPPVSWLNRLRKRPSSLGNR

SEQ ID NO: 22829 - protein, 182 aa, Homo sapiens
  Payload ID: 4586
  Gene Symbol: DDX23
  Gene Name: DEAD (Asp-Glu-Ala-Asp) box polypeptide 23
  ENSP ID: ENSP00000449639
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVE

SEQ ID NO: 22830 - protein, 259 aa, Homo sapiens
  Payload ID: 4586
  Gene Symbol: DDX23
  Gene Name: DEAD (Asp-Glu-Ala-Asp) box polypeptide 23
  ENSP ID: ENSP00000449657
AEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHHPHQEAPGRDHLCLTQHSSCGLRASPKLPDACFSEPSHPSFQVLTLGIWGLRKTIQLPSPDPQVRRPACGAAKGEDDAVGGRESKLPQLLGPVLPFFALGLHWAISSCQAMGAASWHCSPD

SEQ ID NO: 22831 - protein, 796 aa, Homo sapiens
  Payload ID: 4587
  Gene Symbol: DDX27
  Gene Name: DEAD (Asp-Glu-Ala-Asp) box polypeptide 27
  Uniprot ID: Q96GQ7
  ENSP ID: ENSP00000360828
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 22832 - protein, 169 aa, Homo sapiens
  Payload ID: 4587
  Gene Symbol: DDX27
  Gene Name: DEAD (Asp-Glu-Ala-Asp) box polypeptide 27
  ENSP ID: ENSP00000481808
MLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKAGKLLHHAATKCPHL

SEQ ID NO: 22833 - protein, 765 aa, Homo sapiens
  Payload ID: 4587
  Gene Symbol: DDX27
  Gene Name: DEAD (Asp-Glu-Ala-Asp) box polypeptide 27
  ENSP ID: ENSP00000482680
MLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 22834 - protein, 275 aa, Homo sapiens
  Payload ID: 4587
  Gene Symbol: DDX27
  Gene Name: DEAD (Asp-Glu-Ala-Asp) box polypeptide 27
  ENSP ID: ENSP00000483119
  MOD_RES (1)..(1): Any amino acid
XVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADSPPVDTAWPHAPTLWLLHLPFPQPGAISCPFRMLDEYFEEQMKEIIRMCSHHRQTMLFSATMTDEVKDLASVSLKNPVRIFVNSNTDVAP

SEQ ID NO: 22835 - protein, 796 aa, Homo sapiens; identical to SEQ ID NO: 22831
  Payload ID: 4587
  Gene Symbol: DDX27
  Gene Name: DEAD (Asp-Glu-Ala-Asp) box polypeptide 27
  Uniprot ID: Q96GQ7
  ENSP ID: ENSP00000483495

SEQ ID NO: 22836 - protein, 540 aa, Homo sapiens
  Payload ID: 4588
  Gene Symbol: DDX28
  Gene Name: DEAD (Asp-Glu-Ala-Asp) box polypeptide 28
  Uniprot ID: Q9NUL7
  ENSP ID: ENSP00000332340
MALTRPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 22837 - protein, 585 aa, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENSP ID: ENSP00000310539
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCT

SEQ ID NO: 22838 - protein, 851 aa, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENSP ID: ENSP00000361226
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 22839 - protein, 851 aa, Homo sapiens; identical to SEQ ID NO: 22838
  Payload ID: 4589
  Gene Symbol: DDX31
  Gene Name: DEAD (Asp-Glu-Ala-Asp) box polypeptide 31
  Uniprot ID: Q9H8H2
  ENSP ID: ENSP00000361232

SEQ ID NO: 22840 - protein, 746 aa, Homo sapiens
  Payload ID: 4589
  Gene Symbol: DDX31
  Gene Name: DEAD (Asp-Glu-Ala-Asp) box polypeptide 31
  ENSP ID: ENSP00000387730
MAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 22841 - protein, 319 aa, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENSP ID: ENSP00000479697
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQVLLLSTFYEEEQRLRKVK

SEQ ID NO: 22842 - protein, 427 aa, Homo sapiens
  Payload ID: 4590
  Gene Symbol: DDX39A
  Gene Name: DEAD (Asp-Glu-Ala-Asp) box polypeptide 39A
  Uniprot ID: O00148
  ENSP ID: ENSP00000242776
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQVIIFVKSVQRCMALAQLLVEQNFPAIAIHRGMAQEERLSRYQQFKDFQRRILVATNLFGRGMDIERVNIVFNYDMPEDSDTYLHRVARAGRFGTKGLAITFVSDENDAKILNDVQDRFEVNVAELPEEIDISTYIEQSR

SEQ ID NO: 22843 - protein, 322 aa, Homo sapiens
  Payload ID: 4590
  Gene Symbol: DDX39A
  Gene Name: DEAD (Asp-Glu-Ala-Asp) box polypeptide 39A
  Uniprot ID: O00148
  ENSP ID: ENSP00000322749
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDPMEVFVDDETKLTLHGLQQYYVKLKDSEKNRKLFDLLDVLEFNQPVTLSAVQGFPAADPGGHQSVWPGDGHRASQHRL

SEQ ID NO: 22844 - protein, 267 aa, Homo sapiens
  Payload ID: 4590
  Gene Symbol: DDX39A
  Gene Name: DEAD (Asp-Glu-Ala-Asp) box polypeptide 39A
  Uniprot ID: O00148
  ENSP ID: ENSP00000392929
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQDVLWEVSHKGVAHWKVLGRRDAQR

SEQ ID NO: 22845 - protein, 125 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000464801
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELA

SEQ ID NO: 22846 - protein, 108 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000465926
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEP

SEQ ID NO: 22847 - protein, 130 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000466810
MAEQDVENDLLDYDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISK

SEQ ID NO: 22848 - protein, 92 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000467040
MAEQDVENDLLDYDEEEEPQAPQESTPAPPKKDIKGSYVSIHSSGFRDFLLKPELLRAIVDCGFEHPSEVQHECIPQAILGMDVLCQAKSGM

SEQ ID NO: 22849 - protein, 189 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000467411
  MOD_RES (1)..(1): Any amino acid
XDEEEEPQAPQESTPAPPKKDIKGSYVSIHSSGFRDFLLKPELLRAIVDCGFEHPSEVQHECIPQAILGMDVLCQAKSGMGKTAVFVLATLQQIEPVNGQVTVLVMCHTRELAFQISKEYERFSKYMPSVKDEEVLKKNCPHVVVGTPGRILALVRNRSFSLKNVKHFVLDECDKMLEQLDMRRDVQEI

SEQ ID NO: 22850 - protein, 267 aa, Homo sapiens; identical to SEQ ID NO: 22844
  Payload ID: 4590
  Gene Symbol: DDX39A
  Gene Name: DEAD (Asp-Glu-Ala-Asp) box polypeptide 39A
  Uniprot ID: O00148
  ENSP ID: ENSP00000467862

SEQ ID NO: 22851 - protein, 255 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000467911
MAEQDVENDLLDYDEEEEPQAPQESTPAPPKKDIKGSYVSIHSSGFRDFLLKPELLRAIVDCGFEHPSEGSRPSRSASPAVQHECIPQAILGMDVLCQAKSGMGKTAVFVLATLQQIEPVNGQVTVLVMCHTRELAFQISKEYERFSKYMPSVKVSVFFGGLSIKKDEEVLKKNCPHVVVGTPGRILALVRNRSFSLKNVKHFVLDECDKMLEQLDMRRDVQEIFRLTPHEKQCMMFSATLSKDIRPVCRKFMQD

SEQ ID NO: 22852 - protein, 96 aa, Homo sapiens
  Payload ID: 4590
  Gene Symbol: DDX39A
  Gene Name: DEAD (Asp-Glu-Ala-Asp) box polypeptide 39A
  ENSP ID: ENSP00000485838
VTVLVMCHTRELAFQISKEYERFSKYMPSVKVSVFFGGLSIKKDEEVLKKNCPHVVVGTPGRILALVRNRSFSLKNVKHFVLDECDKMLEQLGSPP

SEQ ID NO: 22853 - protein, 425 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000365347
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRCYPLSPSRWPEQAGLAPRAWLSHLCPMRMMPRSSMMCRIALRSILVSCLMR

SEQ ID NO: 22854 - protein, 428 aa, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000373000
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 22855 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000379475

SEQ ID NO: 22856 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000383149

SEQ ID NO: 22857 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000383151

SEQ ID NO: 22858 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000383152

SEQ ID NO: 22859 - protein, 187 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000387452
  MOD_RES (1)..(1): Any amino acid
XSEERDIGKPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSY

SEQ ID NO: 22860 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000387994

SEQ ID NO: 22861 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000388243
  MOD_RES (1)..(1): Any amino acid

SEQ ID NO: 22862 - protein, 197 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000388382
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVCFCDSHFPRGDNEELHLPYVSVYFLPKVSVLVMCHTRELAFQISKEYERFSKYMPNVKVAVFFGGLSIKKDEEVLKKNCPHIV

SEQ ID NO: 22863 - protein, 136 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000388776
MGGGRRPYDVFFSKVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCH

SEQ ID NO: 22864 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000388880

SEQ ID NO: 22865 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000389350

SEQ ID NO: 22866 - protein, 231 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000390562
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATL

SEQ ID NO: 22867 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000390999

SEQ ID NO: 22868 - protein, 95 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000391070
MAENDVDNELLDYEDDEVETAAGGDGAEAPAKKDVKGSYVSIHSSGFRDFLLKPELLRAIVDCGFEHPSEVQHECIPQAILGMDVLCQAKSGMGK

SEQ ID NO: 22869 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000391335
  MOD_RES (1)..(1): Any amino acid

SEQ ID NO: 22870 - protein, 95 aa, Homo sapiens; identical to SEQ ID NO: 22868
  Payload ID: 4591
  Gene Symbol: DDX39B
  Gene Name: DEAD (Asp-Glu-Ala-Asp) box polypeptide 39B
  ENSP ID: ENSP00000391441

SEQ ID NO: 22871 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000391463

SEQ ID NO: 22872 - protein, 187 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000391480
MGSSHIGGLSINERRCSASLGLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKN

SEQ ID NO: 22873 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000391580

SEQ ID NO: 22874 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000392644
  MOD_RES (1)..(1): Any amino acid

SEQ ID NO: 22875 - protein, 238 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000392672
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPV

SEQ ID NO: 22876 - protein, 235 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000392819
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEI

SEQ ID NO: 22877 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000392922

SEQ ID NO: 22878 - protein, 245 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000393172
MWTMSSWTMKMMRWRQQLGEMGLRPLPRRMSRAPMSPSTALAFVTSCSSQSCSGPLSTVALSIRQKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQ

SEQ ID NO: 22879 - protein, 95 aa, Homo sapiens; identical to SEQ ID NO: 22868
  Payload ID: 4591
  Gene Symbol: DDX39B
  Gene Name: DEAD (Asp-Glu-Ala-Asp) box polypeptide 39B
  ENSP ID: ENSP00000393650

SEQ ID NO: 22880 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000393712

SEQ ID NO: 22881 - protein, 125 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000393984
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTREL

SEQ ID NO: 22882 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000394160

SEQ ID NO: 22883 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000394329

SEQ ID NO: 22884 - protein, 135 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000394491
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEI

SEQ ID NO: 22885 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000394963

SEQ ID NO: 22886 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000395058

SEQ ID NO: 22887 - protein, 132 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000395105
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVCFCDSHFPRGDNEELHLP

SEQ ID NO: 22888 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000395618

SEQ ID NO: 22889 - protein, 289 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000395671
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQ

SEQ ID NO: 22890 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000396021
  MOD_RES (1)..(1): Any amino acid

SEQ ID NO: 22891 - protein, 189 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000396559
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQ

SEQ ID NO: 22892 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000396623

SEQ ID NO: 22893 - protein, 21 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000396811
  MOD_RES (1)..(1): Any amino acid
XATLQQLEPVTGQVSVLVMCH

SEQ ID NO: 22894 - protein, 187 aa, Homo sapiens; identical to SEQ ID NO: 22872
  Payload ID: 4591
  Gene Symbol: DDX39B
  Gene Name: DEAD (Asp-Glu-Ala-Asp) box polypeptide 39B
  ENSP ID: ENSP00000396885

SEQ ID NO: 22895 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000396930

SEQ ID NO: 22896 - protein, 25 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000397591
  MOD_RES (1)..(1): Any amino acid
XATLQQLEPVTGQVSVLVMCHTREL

SEQ ID NO: 22897 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000398190
  MOD_RES (1)..(1): Any amino acid

SEQ ID NO: 22898 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000398274

SEQ ID NO: 22899 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000398492

SEQ ID NO: 22900 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000398775

SEQ ID NO: 22901 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000398978

SEQ ID NO: 22902 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000399030

SEQ ID NO: 22903 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000399371

SEQ ID NO: 22904 - protein, 328 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000399542
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 22905 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000399659

SEQ ID NO: 22906 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000399841

SEQ ID NO: 22907 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000400326

SEQ ID NO: 22908 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000400556

SEQ ID NO: 22909 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000402876

SEQ ID NO: 22910 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000402942

SEQ ID NO: 22911 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000403358

SEQ ID NO: 22912 - protein, 95 aa, Homo sapiens; identical to SEQ ID NO: 22868
  Payload ID: 4591
  Gene Symbol: DDX39B
  Gene Name: DEAD (Asp-Glu-Ala-Asp) box polypeptide 39B
  ENSP ID: ENSP00000403593

SEQ ID NO: 22913 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000404228

SEQ ID NO: 22914 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000404695

SEQ ID NO: 22915 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000404735

SEQ ID NO: 22916 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000405245

SEQ ID NO: 22917 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000405374

SEQ ID NO: 22918 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000405386

SEQ ID NO: 22919 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000405489

SEQ ID NO: 22920 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000405560

SEQ ID NO: 22921 - protein, 138 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000405665
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPV

SEQ ID NO: 22922 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000405707

SEQ ID NO: 22923 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000405964

SEQ ID NO: 22924 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000406006

SEQ ID NO: 22925 - protein, 64 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000406060
  MOD_RES (1)..(1): Any amino acid
XATLQQLEPVTGQVSVLVMCHTRELAFQISKEYERFSKYMPNVKVAVFFGGLSIKKDEEVLKKN

SEQ ID NO: 22926 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000406085

SEQ ID NO: 22927 - protein, 238 aa, Homo sapiens; identical to SEQ ID NO: 22875
  Payload ID: 4591
  Gene Symbol: DDX39B
  Gene Name: DEAD (Asp-Glu-Ala-Asp) box polypeptide 39B
  ENSP ID: ENSP00000406096

SEQ ID NO: 22928 - protein, 328 aa, Homo sapiens; identical to SEQ ID NO: 22904
  Payload ID: 4591
  Gene Symbol: DDX39B
  Gene Name: DEAD (Asp-Glu-Ala-Asp) box polypeptide 39B
  ENSP ID: ENSP00000406348
  MOD_RES (1)..(1): Any amino acid

SEQ ID NO: 22929 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000406422
  MOD_RES (1)..(1): Any amino acid

SEQ ID NO: 22930 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000406504

SEQ ID NO: 22931 - protein, 131 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000406739
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATL

SEQ ID NO: 22932 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000407054

SEQ ID NO: 22933 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000407419

SEQ ID NO: 22934 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000407427

SEQ ID NO: 22935 - protein, 187 aa, Homo sapiens; identical to SEQ ID NO: 22872
  Payload ID: 4591
  Gene Symbol: DDX39B
  Gene Name: DEAD (Asp-Glu-Ala-Asp) box polypeptide 39B
  ENSP ID: ENSP00000407519

SEQ ID NO: 22936 - protein, 425 aa, Homo sapiens; identical to SEQ ID NO: 22853
  Payload ID: 4591
  Gene Symbol: DDX39B
  Gene Name: DEAD (Asp-Glu-Ala-Asp) box polypeptide 39B
  ENSP ID: ENSP00000407647

SEQ ID NO: 22937 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000408000

SEQ ID NO: 22938 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000408067

SEQ ID NO: 22939 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000408191

SEQ ID NO: 22940 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000408609

SEQ ID NO: 22941 - protein, 97 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000408832
  MOD_RES (1)..(1): Any amino acid
XATLQQLEPVTGQVCFCDSHFPRGDNEELHLPYVSVYFLPKVSVLVMCHTRELAFQISKEYERFSKYMPNVKVAVFFGGLSIKKDEEVLKKNCPHIV

SEQ ID NO: 22942 - protein, 187 aa, Homo sapiens; identical to SEQ ID NO: 22872
  Payload ID: 4591
  Gene Symbol: DDX39B
  Gene Name: DEAD (Asp-Glu-Ala-Asp) box polypeptide 39B
  ENSP ID: ENSP00000408908

SEQ ID NO: 22943 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000409162

SEQ ID NO: 22944 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000409290

SEQ ID NO: 22945 - protein, 187 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000409426
MGSSHIGGLSINERRRSASLGLVMAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKN

SEQ ID NO: 22946 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000409451

SEQ ID NO: 22947 - protein, 32 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000409602
  MOD_RES (1)..(1): Any amino acid
XATLQQLEPVTGQVCFCDSHFPRGDNEELHLP

SEQ ID NO: 22948 - protein, 197 aa, Homo sapiens; identical to SEQ ID NO: 22862
  Payload ID: 4591
  Gene Symbol: DDX39B
  Gene Name: DEAD (Asp-Glu-Ala-Asp) box polypeptide 39B
  ENSP ID: ENSP00000409810

SEQ ID NO: 22949 - protein, 125 aa, Homo sapiens; identical to SEQ ID NO: 22881
  Payload ID: 4591
  Gene Symbol: DDX39B
  Gene Name: DEAD (Asp-Glu-Ala-Asp) box polypeptide 39B
  ENSP ID: ENSP00000409929

SEQ ID NO: 22950 - protein, 187 aa, Homo sapiens; identical to SEQ ID NO: 22859
  Payload ID: 4591
  Gene Symbol: DDX39B
  Gene Name: DEAD (Asp-Glu-Ala-Asp) box polypeptide 39B
  ENSP ID: ENSP00000410112
  MOD_RES (1)..(1): Any amino acid

SEQ ID NO: 22951 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000410277

SEQ ID NO: 22952 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000410313

SEQ ID NO: 22953 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000410915

SEQ ID NO: 22954 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000411136

SEQ ID NO: 22955 - protein, 132 aa, Homo sapiens; identical to SEQ ID NO: 22887
  Payload ID: 4591
  Gene Symbol: DDX39B
  Gene Name: DEAD (Asp-Glu-Ala-Asp) box polypeptide 39B
  ENSP ID: ENSP00000411371

SEQ ID NO: 22956 - protein, 187 aa, Homo sapiens; identical to SEQ ID NO: 22872
  Payload ID: 4591
  Gene Symbol: DDX39B
  Gene Name: DEAD (Asp-Glu-Ala-Asp) box polypeptide 39B
  ENSP ID: ENSP00000411458

SEQ ID NO: 22957 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000411538

SEQ ID NO: 22958 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000411853

SEQ ID NO: 22959 - protein, 95 aa, Homo sapiens; identical to SEQ ID NO: 22868
  Payload ID: 4591
  Gene Symbol: DDX39B
  Gene Name: DEAD (Asp-Glu-Ala-Asp) box polypeptide 39B
  ENSP ID: ENSP00000411865

SEQ ID NO: 22960 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000411967

SEQ ID NO: 22961 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000412286

SEQ ID NO: 22962 - protein, 328 aa, Homo sapiens; identical to SEQ ID NO: 22904
  Payload ID: 4591
  Gene Symbol: DDX39B
  Gene Name: DEAD (Asp-Glu-Ala-Asp) box polypeptide 39B
  ENSP ID: ENSP00000412609
  MOD_RES (1)..(1): Any amino acid

SEQ ID NO: 22963 - protein, 187 aa, Homo sapiens; identical to SEQ ID NO: 22945
  Payload ID: 4591
  Gene Symbol: DDX39B
  Gene Name: DEAD (Asp-Glu-Ala-Asp) box polypeptide 39B
  ENSP ID: ENSP00000413149

SEQ ID NO: 22964 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000413576

SEQ ID NO: 22965 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000413790

SEQ ID NO: 22966 - protein, 95 aa, Homo sapiens; identical to SEQ ID NO: 22868
  Payload ID: 4591
  Gene Symbol: DDX39B
  Gene Name: DEAD (Asp-Glu-Ala-Asp) box polypeptide 39B
  ENSP ID: ENSP00000413793

SEQ ID NO: 22967 - protein, 289 aa, Homo sapiens; identical to SEQ ID NO: 22889
  Payload ID: 4591
  Gene Symbol: DDX39B
  Gene Name: DEAD (Asp-Glu-Ala-Asp) box polypeptide 39B
  ENSP ID: ENSP00000413832

SEQ ID NO: 22968 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000414082

SEQ ID NO: 22969 - protein, 245 aa, Homo sapiens; identical to SEQ ID NO: 22878
  Payload ID: 4591
  Gene Symbol: DDX39B
  Gene Name: DEAD (Asp-Glu-Ala-Asp) box polypeptide 39B
  ENSP ID: ENSP00000414096

SEQ ID NO: 22970 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000414984

SEQ ID NO: 22971 - protein, 325 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000415802
  MOD_RES (1)..(1): Any amino acid
XATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRCYPLSPSRWPEQAGLAPRAWLSHLCPMRMMPRSSMMCRIALRSILVSCLMR

SEQ ID NO: 22972 - protein, 428 aa, Homo sapiens; identical to SEQ ID NO: 22854
  Payload ID: 4591
  Gene Symbol: DDX39B
  Gene Name: DEAD (Asp-Glu-Ala-Asp) box polypeptide 39B
  Uniprot ID: Q13838
  ENSP ID: ENSP00000416269

SEQ ID NO: 22973 - protein, 231 aa, Homo sapiens; identical to SEQ ID NO: 22866
  Payload ID: 4591
  Gene Symbol: DDX39B
  Gene Name: DEAD (Asp-Glu-Ala-Asp) box polypeptide 39B
  ENSP ID: ENSP00000416350

SEQ ID NO: 22974 - protein, 179 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000416358
VAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQ

SEQ ID NO: 22975 - protein, 235 aa, Homo sapiens; identical to SEQ ID NO: 22876
  Payload ID: 4591
  Gene Symbol: DDX39B
  Gene Name: DEAD (Asp-Glu-Ala-Asp) box polypeptide 39B
  ENSP ID: ENSP00000416407

SEQ ID NO: 22976 - protein, 136 aa, Homo sapiens; identical to SEQ ID NO: 22863
  Payload ID: 4591
  Gene Symbol: DDX39B
  Gene Name: DEAD (Asp-Glu-Ala-Asp) box polypeptide 39B
  ENSP ID: ENSP00000416843

SEQ ID NO: 22977 - protein, 141 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000431377
  MOD_RES (1)..(1): Any amino acid
XDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEESLKIFNDEFLWLPTYLAEAWTSSG

SEQ ID NO: 22978 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000431969
  MOD_RES (1)..(1): Any amino acid

SEQ ID NO: 22979 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000432296
  MOD_RES (1)..(1): Any amino acid

SEQ ID NO: 22980 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000433192
  MOD_RES (1)..(1): Any amino acid

SEQ ID NO: 22981 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000433234
  MOD_RES (1)..(1): Any amino acid

SEQ ID NO: 22982 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000434615
  MOD_RES (1)..(1): Any amino acid

SEQ ID NO: 22983 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000434736
  MOD_RES (1)..(1): Any amino acid

SEQ ID NO: 22984 - protein, 141 aa, Homo sapiens; identical to SEQ ID NO: 22977
  Payload ID: 4591
  Gene Symbol: DDX39B
  Gene Name: DEAD (Asp-Glu-Ala-Asp) box polypeptide 39B
  ENSP ID: ENSP00000436220
  MOD_RES (1)..(1): Any amino acid

SEQ ID NO: 22985 - protein, 247 aa, Homo sapiens
  Payload ID: 4591
  Gene Symbol: DDX39B
  Gene Name: DEAD (Asp-Glu-Ala-Asp) box polypeptide 39B
  ENSP ID: ENSP00000437017
MWTMSSWTMKMMRWRQQLGEMGLRPLPRRMSRAPMSPSTALAFVTSCSSQSCSGPLSTVALSIRQKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEE

SEQ ID NO: 22986 - protein, 690 aa, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENSP ID: ENSP00000334167
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGDNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 22987 - protein, 690 aa, Homo sapiens; identical to SEQ ID NO: 22986
  Payload ID: 4592
  Gene Symbol: DDX4
  Gene Name: DEAD (Asp-Glu-Ala-Asp) box polypeptide 4
  Uniprot ID: Q9NQI0
  ENSP ID: ENSP00000347087

SEQ ID NO: 22988 - protein, 105 aa, Homo sapiens
  Payload ID: 4592
  Gene Symbol: DDX4
  Gene Name: DEAD (Asp-Glu-Ala-Asp) box polypeptide 4
  ENSP ID: ENSP00000421960
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGD

SEQ ID NO: 22989 - protein, 305 aa, Homo sapiens
  Payload ID: 4592
  Gene Symbol: DDX4
  Gene Name: DEAD (Asp-Glu-Ala-Asp) box polypeptide 4
  ENSP ID: ENSP00000423102
  MOD_RES (1)..(1): Any amino acid
XFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGLVSNRSNT

SEQ ID NO: 22990 - protein, 575 aa, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENSP ID: ENSP00000423123
MGSRNLFLTNSPESSNDCEDNPTRNRGFSKRGDNDLDPDECMQRTGGLFGSRRPVLSGTGNGDTSQSRSGSGSERDSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 22991 - protein, 159 aa, Homo sapiens
  Payload ID: 4592
  Gene Symbol: DDX4
  Gene Name: DEAD (Asp-Glu-Ala-Asp) box polypeptide 4
  ENSP ID: ENSP00000424112
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGG

SEQ ID NO: 22992 - protein, 142 aa, Homo sapiens
  Payload ID: 4592
  Gene Symbol: DDX4
  Gene Name: DEAD (Asp-Glu-Ala-Asp) box polypeptide 4
  ENSP ID: ENSP00000424779
MGDEDWEAEINPHMSSYVPIFEKDRYSGENGDNFNRTPASSSDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNND

SEQ ID NO: 22993 - protein, 724 aa, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENSP ID: ENSP00000424838
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 22994 - protein, 704 aa, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENSP ID: ENSP00000425359
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 22995 - protein, 518 aa, Homo sapiens
  Payload ID: 4592
  Gene Symbol: DDX4
  Gene Name: DEAD (Asp-Glu-Ala-Asp) box polypeptide 4
  ENSP ID: ENSP00000427167
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNI

SEQ ID NO: 22996 - protein, 156 aa, Homo sapiens
  Payload ID: 4592
  Gene Symbol: DDX4
  Gene Name: DEAD (Asp-Glu-Ala-Asp) box polypeptide 4
  ENSP ID: ENSP00000427522
MWQLYSPEISTIRHLHVACRLIGDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGC

SEQ ID NO: 22997 - protein, 50 aa, Homo sapiens
  Payload ID: 4592
  Gene Symbol: DDX4
  Gene Name: DEAD (Asp-Glu-Ala-Asp) box polypeptide 4
  ENSP ID: ENSP00000430431
  MOD_RES (1)..(1): Any amino acid
XGSRNLFLTNSPESSNDCEDNPTRNRGFSKRGGKDHILEQFVLNTETLNW

SEQ ID NO: 22998 - protein, 640 aa, Homo sapiens
  Payload ID: 4593
  Gene Symbol: DDX41
  Gene Name: DEAD (Asp-Glu-Ala-Asp) box polypeptide 41
  ENSP ID: ENSP00000330349
RREARPRACGSGREEGSRPCLTGVCLQRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 22999 - protein, 173 aa, Homo sapiens
  Payload ID: 4593
  Gene Symbol: DDX41
  Gene Name: DEAD (Asp-Glu-Ala-Asp) box polypeptide 41
  ENSP ID: ENSP00000421460
  MOD_RES (1)..(1): Any amino acid
XIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHAVQSSADHQRPWTRPSVHRWARPHPGGLPPRTSEY

SEQ ID NO: 23000 - protein, 622 aa, Homo sapiens
  Payload ID: 4593
  Gene Symbol: DDX41
  Gene Name: DEAD (Asp-Glu-Ala-Asp) box polypeptide 41
  Uniprot ID: Q9UJV9
  ENSP ID: ENSP00000422753
MEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAAILRGLKKKGIHHPTPIQIQGIPTILSGRDMIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 23001 - protein, 126 aa, Homo sapiens
  Payload ID: 4593
  Gene Symbol: DDX41
  Gene Name: DEAD (Asp-Glu-Ala-Asp) box polypeptide 41
  ENSP ID: ENSP00000425739
LDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAVSSSATCRGSASFTGFGALRKYL

SEQ ID NO: 23002 - protein, 201 aa, Homo sapiens
  Payload ID: 4593
  Gene Symbol: DDX41
  Gene Name: DEAD (Asp-Glu-Ala-Asp) box polypeptide 41
  ENSP ID: ENSP00000426330
MEESEPERKRARTDEVPAGGSRSEAEDEDDEDYVPYVPLRQRRQLLLQKLLQRRRKGAAEEEQQDSGSEPRGDEDDIPLGPQSNVSLLDQHQHLKEKAEARKESAKEKQLKEEEKILESVAEGRALMSVKEMAKGITYDDPIKTSWTPPRYVLSMSEERHERVRKKYHILVEGDGIPPPIKSFKEMKFPAGVVPVLQALGL

SEQ ID NO: 23003 - protein, 49 aa, Homo sapiens
  Payload ID: 4593
  Gene Symbol: DDX41
  Gene Name: DEAD (Asp-Glu-Ala-Asp) box polypeptide 41
  ENSP ID: ENSP00000427082
MEESEPERKRARTDEVPAGGSRSEAEDEDDEDYVPYVPLRQRRQLLPGS

SEQ ID NO: 23004 - protein, 201 aa, Homo sapiens; identical to SEQ ID NO: 23002
  Payload ID: 4593
  Gene Symbol: DDX41
  Gene Name: DEAD (Asp-Glu-Ala-Asp) box polypeptide 41
  ENSP ID: ENSP00000486367

SEQ ID NO: 23005 - protein, 49 aa, Homo sapiens; identical to SEQ ID NO: 23003
  Payload ID: 4593
  Gene Symbol: DDX41
  Gene Name: DEAD (Asp-Glu-Ala-Asp) box polypeptide 41
  ENSP ID: ENSP00000487280

SEQ ID NO: 23006 - protein, 648 aa, Homo sapiens
  Payload ID: 4594
  Gene Symbol: DDX43
  Gene Name: DEAD (Asp-Glu-Ala-Asp) box polypeptide 43
  Uniprot ID: Q9NXZ2
  ENSP ID: ENSP00000359361
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFKAHQQKREMERKMERPQGRPKKFH

SEQ ID NO: 23007 - protein, 1031 aa, Homo sapiens
  Payload ID: 4595
  Gene Symbol: DDX46
  Gene Name: DEAD (Asp-Glu-Ala-Asp) box polypeptide 46
  Uniprot ID: Q7L014
  ENSP ID: ENSP00000346236
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 23008 - protein, 1032 aa, Homo sapiens
  Payload ID: 4595
  Gene Symbol: DDX46
  Gene Name: DEAD (Asp-Glu-Ala-Asp) box polypeptide 46
  ENSP ID: ENSP00000416534
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 23009 - protein, 70 aa, Homo sapiens
  Payload ID: 4595
  Gene Symbol: DDX46
  Gene Name: DEAD (Asp-Glu-Ala-Asp) box polypeptide 46
  ENSP ID: ENSP00000425073
  MOD_RES (1)..(1): Any amino acid
XEAAITIRGTYFPPGKEPKEGERKIYLAIESANELAVQKAKAEITRLIKEELIRLQNSYQPTNKGRYKVL

SEQ ID NO: 23010 - protein, 29 aa, Homo sapiens
  Payload ID: 4595
  Gene Symbol: DDX46
  Gene Name: DEAD (Asp-Glu-Ala-Asp) box polypeptide 46
  ENSP ID: ENSP00000426767
  MOD_RES (1)..(1): Any amino acid
XEVPELAKMSQEGMAMKSPRPSKPKLFLL

SEQ ID NO: 23011 - protein, 471 aa, Homo sapiens
  Payload ID: 4595
  Gene Symbol: DDX46
  Gene Name: DEAD (Asp-Glu-Ala-Asp) box polypeptide 46
  ENSP ID: ENSP00000427290
MGRESRHYRKRSASRGRSGSRSRSRSPSDKRSKRGDDRRSRSRDRDRRRERSRSRDKRRSRSRDRKRLRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGDAVR

SEQ ID NO: 23012 - protein, 471 aa, Homo sapiens; identical to SEQ ID NO: 23011
  Payload ID: 4595
  Gene Symbol: DDX46
  Gene Name: DEAD (Asp-Glu-Ala-Asp) box polypeptide 46
  ENSP ID: ENSP00000487025

SEQ ID NO: 23013 - protein, 406 aa, Homo sapiens
  Payload ID: 4596
  Gene Symbol: DDX47
  Gene Name: DEAD (Asp-Glu-Ala-Asp) box polypeptide 47
  Uniprot ID: Q9H0S4
  ENSP ID: ENSP00000319578
MAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 23014 - protein, 455 aa, Homo sapiens
  Payload ID: 4596
  Gene Symbol: DDX47
  Gene Name: DEAD (Asp-Glu-Ala-Asp) box polypeptide 47
  Uniprot ID: Q9H0S4
  ENSP ID: ENSP00000350698
MAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEQFEALGSSIGVQSAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKDTYLVYILNELAGNSFMIFCSTCNNTQRTALLLRNLGFTAIPLHGQMSQSKRLGSLNKFKAKARSILLATDVASRGLDIPHVDVVVNFDIPTHSKDYIHRVGRTARAGRSGKAITFVTQYDVELFQRIEHLIGKKLPGFPTQDDEVMMLTERVAEAQRFARMELREHGEKKKRSREDAGDNDDTEGAIGVRNKVAGGKMKKRKGR

SEQ ID NO: 23015 - protein, 196 aa, Homo sapiens
  Payload ID: 4596
  Gene Symbol: DDX47
  Gene Name: DEAD (Asp-Glu-Ala-Asp) box polypeptide 47
  ENSP ID: ENSP00000444000
MAAPEEHDSPTEASQPIVEEEETKTFKDLGVTDVLCEACDQLGWTKPTKIQIEAIPLALQAVIVGGIDSMSQSLALAKKPHIIIATPGRLIDHLENTKGFNLRALKYLVMDEADRILNMDFETEVDKILKVIPRDRKTFLFSATMTKKVQKLQRAALKNPVKCAVSSKYQTVEKLQQYYIFIPSKFKSKRLGSLNK

SEQ ID NO: 23016 - protein, 483 aa, Homo sapiens
  Payload ID: 4597
  Gene Symbol: DDX49
  Gene Name: DEAD (Asp-Glu-Ala-Asp) box polypeptide 49
  Uniprot ID: Q9Y6V7
  ENSP ID: ENSP00000247003
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 23017 - protein, 41 aa, Homo sapiens
  Payload ID: 4597
  Gene Symbol: DDX49
  Gene Name: DEAD (Asp-Glu-Ala-Asp) box polypeptide 49
  ENSP ID: ENSP00000469086
MAGFAELGLSSWLVEQCRQLGLKQPTPVQLGCIPAILEEAV

SEQ ID NO: 23018 - protein, 118 aa, Homo sapiens
  Payload ID: 4597
  Gene Symbol: DDX49
  Gene Name: DEAD (Asp-Glu-Ala-Asp) box polypeptide 49
  ENSP ID: ENSP00000470440
MAGFAELGLSSWLVEQCRQLGLKQPTPVQLGCIPAILEGRDCLGCAKTGSGKTAAFVLPILQKLSEDPYGIFCLVLTPTRIKQDGPGAVAHTCNPSTLGAPGSWPTRSQSSSGSWGSL

SEQ ID NO: 23019 - protein, 166 aa, Homo sapiens
  Payload ID: 4597
  Gene Symbol: DDX49
  Gene Name: DEAD (Asp-Glu-Ala-Asp) box polypeptide 49
  ENSP ID: ENSP00000471292
MAGFAELGLSSWLVEQCRQLGLKQPTPVQLGCIPAILEGRDCLGCAKTGSGKTAAFVLPILQKLSEDPYGIFCLVLTPTRGPAELNKMAPVQWLTPVIPALWELQGAGLPDRRAVPGPGEASRAERLHHRRWHGHGGPGAGALSETTRGHRHAGAPGRSPAQLQHF

SEQ ID NO: 23020 - protein, 112 aa, Homo sapiens
  Payload ID: 4597
  Gene Symbol: DDX49
  Gene Name: DEAD (Asp-Glu-Ala-Asp) box polypeptide 49
  ENSP ID: ENSP00000472084
MAGFAELGLSSWLVEQCRQLGLKQPTPVQLGCIPAILEGRDCLGCAKTGSGKTAAFVLPILQKLSEDPYGIFCLVLTPTRHGGPGAGALSETTRGHRHAGAPGRSPAQLQHF

SEQ ID NO: 23021 - protein, 41 aa, Homo sapiens; identical to SEQ ID NO: 23017
  Payload ID: 4597
  Gene Symbol: DDX49
  Gene Name: DEAD (Asp-Glu-Ala-Asp) box polypeptide 49
  ENSP ID: ENSP00000472289

SEQ ID NO: 23022 - protein, 166 aa, Homo sapiens; identical to SEQ ID NO: 23019
  Payload ID: 4597
  Gene Symbol: DDX49
  Gene Name: DEAD (Asp-Glu-Ala-Asp) box polypeptide 49
  ENSP ID: ENSP00000487048

SEQ ID NO: 23023 - protein, 737 aa, Homo sapiens
  Payload ID: 4598
  Gene Symbol: DDX50
  Gene Name: DEAD (Asp-Glu-Ala-Asp) box polypeptide 50
  Uniprot ID: Q9BQ39
  ENSP ID: ENSP00000362687
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINHIRNGIDILVGTPGRIKDHLQSGRLDLSKLRHVVLDEVDQMLDLGFAEQVEDIIHESYKTDSEDNPQTLLFSATCPQWVYKVAKKYMKSRYEQVDLVGKMTQKAATTVEHLAIQCHWSQRPAVIGDVLQVYSGSEGRAIIFCETKKNVTEMAMNPHIKQNAQCLHGDIAQSQREITLKGFREGSFKVLVATNVAARGLDIPEVDLVIQSSPPQDVESYIHRSGRTGRAGRTGICICFYQPRERGQLRYVEQKAGITFKRVGVPSTMDLVKSKSMDAIRSLASVSYAAVDFFRPSAQRLIEEKGAVDALAAALAHISGASSFEPRSLITSDKGFVTMTLESLEEIQDVSCAWKELNRKLSSNAVSQITRMCLLKGNMGVCFDVPTTESERLQAEWHDSDWILSVPAKLPEIEEYYDGNTSSNSRQRSGWSSGRSGRSGRSGGRSGGRSGRQSRQGSRSGSRQDGRRRSGNRNRSRSGGHKRSFD

SEQ ID NO: 23024 - protein, 51 aa, Homo sapiens
  Payload ID: 4598
  Gene Symbol: DDX50
  Gene Name: DEAD (Asp-Glu-Ala-Asp) box polypeptide 50
  ENSP ID: ENSP00000474314
MPGKLLWGDIMELEAPLEESESQKKERQKSFMDIAISDKGLWTCTSLIGLL

SEQ ID NO: 23025 - protein, 39 aa, Homo sapiens
  Payload ID: 4598
  Gene Symbol: DDX50
  Gene Name: DEAD (Asp-Glu-Ala-Asp) box polypeptide 50
  ENSP ID: ENSP00000474785
MPGKLLWGDIMELEAPLEESESQKKERQKGCYEDLNKIS

SEQ ID NO: 23026 - protein, 730 aa, Homo sapiens [sequence omitted]

SEQ ID NO: 23027 - protein, 666 aa, Homo sapiens
  Payload ID: 4599
  Gene Symbol: DDX51
  Gene Name: DEAD (Asp-Glu-Ala-Asp) box polypeptide 51
  Uniprot ID: Q8N8A6
  ENSP ID: ENSP00000380495
MALFYVARYPGPDAAAAAGPEGAEAGAHGRARALLERLQSRARERQQQREPAQTEAAASTEPATRRRRRPRRRRRVNDAEPGSPEAPQGKRRKADGEDAGAESNEEAPGEPSAGSSEEAPGEPSAGSSEEAPGERSTSASAEAAPDGPALEEAAGPLVPGLVLGGFGKRKAPKVQPFLPRWLAEPNCVRRNVTEDLVPIEDIPDVHPDLQKQLRAHGISSYFPVQAAVIPALLESAACGFLVGRGGYRPSDLCVSAPTGSGKTLAFVIPVVQALLSRVVCHIRALVVLPTKELAQQVSKVFNIYTDATPLRVSLVTGQKSLAKEQESLVQKTADGYRCLADIVVATPGRLVDHIDQTPGFSLQQLRFLIIDEADRMIDSMHQSWLPRVVAAAFQSEDPADPCALLQRRQAQAVTAASTCCPQMPLQKLLFSATLTQNPEKLQQLGLHQPRLFSTGLAHRGLEDTDGDGDSGKYAFPVGLTHHYVPCSLSSKPLVVLHLVLEMGFSRVLCFTNSRENSHRLFLLVQAFGGVDVAEFSSRYGPGQRRMILKQFEQGKIQLLISTDATARGIDVQGVELVVNYDAPQYLRTYVHRVGRTARAGKTGQAFTLLLKVQERRFLRMLTEAGAPELQRHELSSKLLQPLVPRYEEALSQLEESVKEERKQRAA

SEQ ID NO: 23028 - protein, 101 aa, Homo sapiens
  Payload ID: 4600
  Gene Symbol: DDX52
  Gene Name: DEAD (Asp-Glu-Ala-Asp) box polypeptide 52
  ENSP ID: ENSP00000477779
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSDKLLAE

SEQ ID NO: 23029 - protein, 599 aa, Homo sapiens
  Payload ID: 4600
  Gene Symbol: DDX52
  Gene Name: DEAD (Asp-Glu-Ala-Asp) box polypeptide 52
  Uniprot ID: Q9Y2R4
  ENSP ID: ENSP00000479504
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 23030 - protein, 599 aa, Homo sapiens
  Payload ID: 4600
  Gene Symbol: DDX52
  Gene Name: DEAD (Asp-Glu-Ala-Asp) box polypeptide 52
  Uniprot ID: Q9Y2R4
  ENSP ID: ENSP00000480030
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSEIASQEEGATIQWMSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYLLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAMRELVKKGFNPPVLVFVQSIERAKELFHELIYEGINVDVIHAERTQQQRDNTVHSFRAGKIWVLICTALLARGIDFKGVNLVINYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 23031 - protein, 112 aa, Homo sapiens
  Payload ID: 4600
  Gene Symbol: DDX52
  Gene Name: DEAD (Asp-Glu-Ala-Asp) box polypeptide 52
  ENSP ID: ENSP00000483141
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSETGFHHVSQYGLDLLTS

SEQ ID NO: 23032 - protein, 115 aa, Homo sapiens
  Payload ID: 4600
  Gene Symbol: DDX52
  Gene Name: DEAD (Asp-Glu-Ala-Asp) box polypeptide 52
  ENSP ID: ENSP00000483836
  MOD_RES (1)..(1): Any amino acid
XNYDFPTSSVEYIHRIGRTGRAGNKGKAITFFTEDDKPLLRSVANVIQQAGCPVPEYIKGFQKLLSKQKKKMIKKPLERESISTTPKCFLEKAKDKQKKVTGQNSKKKVALEDKS

SEQ ID NO: 23033 - protein, 97 aa, Homo sapiens
  Payload ID: 4600
  Gene Symbol: DDX52
  Gene Name: DEAD (Asp-Glu-Ala-Asp) box polypeptide 52
  ENSP ID: ENSP00000484366
MDVHDLFRRLGAGAKFDTRRFSADAARFQIGKRKYDFDSSEVLQGLDFFGNKKSVPGVCGASQTHQKPQNGEKKEESLTERKREQSKKKRKTMTSGE

SEQ ID NO: 23034 - protein, 101 aa, Homo sapiens; identical to SEQ ID NO: 23028
  Payload ID: 4600
  Gene Symbol: DDX52
  Gene Name: DEAD (Asp-Glu-Ala-Asp) box polypeptide 52
  ENSP ID: ENSP00000487638

SEQ ID NO: 23035 - protein, 112 aa, Homo sapiens; identical to SEQ ID NO: 23031
  Payload ID: 4600
  Gene Symbol: DDX52
  Gene Name: DEAD (Asp-Glu-Ala-Asp) box polypeptide 52
  ENSP ID: ENSP00000487912

SEQ ID NO: 23036 - protein, 97 aa, Homo sapiens; identical to SEQ ID NO: 23033
  Payload ID: 4600
  Gene Symbol: DDX52
  Gene Name: DEAD (Asp-Glu-Ala-Asp) box polypeptide 52
  ENSP ID: ENSP00000488162

SEQ ID NO: 23037 - protein, 115 aa, Homo sapiens; identical to SEQ ID NO: 23032
  Payload ID: 4600
  Gene Symbol: DDX52
  Gene Name: DEAD (Asp-Glu-Ala-Asp) box polypeptide 52
  ENSP ID: ENSP00000488900
  MOD_RES (1)..(1): Any amino acid

SEQ ID NO: 23038 - protein, 631 aa, Homo sapiens
  Payload ID: 4601
  Gene Symbol: DDX53
  Gene Name: DEAD (Asp-Glu-Ala-Asp) box polypeptide 53
  Uniprot ID: Q86TM3
  ENSP ID: ENSP00000368667
MSHWAPEWKRAEANPRDLGASWDVRGSRGSGWSGPFGHQGPRAAGSREPPLCFKIKNNMVGVVIGYSGSKIKDLQHSTNTKIQIINGESEAKVRIFGNREMKAKAKAAIETLIRKQESYNSESSVDNAASQTPIGRNLGRNDIVGEAEPLSNWDRIRAAVVECEKRKWADLPPVKKNFYIESKATSCMSEMQVINWRKENFNITCDDLKSGEKRLIPKPTCRFKDAFQQYPDLLKSIIRVGIVKPTPIQSQAWPIILQGIDLIVVAQTGTGKTLSYLMPGFIHLDSQPISREQRNGPGMLVLTPTRELALHVEAECSKYSYKGLKSICIYGGRNRNGQIEDISKGVDIIIATPGRLNDLQMNNSVNLRSITYLVIDEADKMLDMEFEPQIRKILLDVRPDRQTVMTSATWPDTVRQLALSYLKDPMIVYVGNLNLVAVNTVKQNIIVTTEKEKRALTQEFVENMSPNDKVIMFVSQKHIADDLSSDFNIQGISAESLHGNSEQSDQERAVEDFKSGNIKILITTDIVSRGLDLNDVTHVYNYDFPRNIDVYVHRVGYIGRTGKTGTSVTLITQRDSKMAGELIKILDRANQSVPEDLVVMAEQYKLNQQKRHRETRSRKPGQRRKEFYFLS

SEQ ID NO: 23039 - protein, 881 aa, Homo sapiens
  Payload ID: 4602
  Gene Symbol: DDX54
  Gene Name: DEAD (Asp-Glu-Ala-Asp) box polypeptide 54
  Uniprot ID: Q8TDD1
  ENSP ID: ENSP00000304072
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQGASRPHAPGTPAGRVRPELKTKQQILKQRRRAQKLHFLQRGGLKQLSARNRRRVQELQQGAFGRGARSKKGKMRKRM

SEQ ID NO: 23040 - protein, 882 aa, Homo sapiens
  Payload ID: 4602
  Gene Symbol: DDX54
  Gene Name: DEAD (Asp-Glu-Ala-Asp) box polypeptide 54
  Uniprot ID: Q8TDD1
  ENSP ID: ENSP00000323858
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQAGASRPHAPGTPAGRVRPELKTKQQILKQRRRAQKLHFLQRGGLKQLSARNRRRVQELQQGAFGRGARSKKGKMRKRM

SEQ ID NO: 23041 - protein, 160 aa, Homo sapiens
  Payload ID: 4602
  Gene Symbol: DDX54
  Gene Name: DEAD (Asp-Glu-Ala-Asp) box polypeptide 54
  ENSP ID: ENSP00000447098
  MOD_RES (1)..(1): Any amino acid
XPSPESIKRAKEMDLVGLGLHPLFSSRFEEEELQRLRLVDSIKNYRSRADIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGR

SEQ ID NO: 23042 - protein, 82 aa, Homo sapiens
  Payload ID: 4602
  Gene Symbol: DDX54
  Gene Name: DEAD (Asp-Glu-Ala-Asp) box polypeptide 54
  ENSP ID: ENSP00000448189
  MOD_RES (1)..(1): Any amino acid
XKGPAAGPRSRAAMAQWRKKKGLRKRRGAASQARGSDSEDGEFEIQAEDDARARKLGPGRPLPTFPTSECTSDVEPDTREMA

SEQ ID NO: 23043 - protein, 208 aa, Homo sapiens
  Payload ID: 4602
  Gene Symbol: DDX54
  Gene Name: DEAD (Asp-Glu-Ala-Asp) box polypeptide 54
  ENSP ID: ENSP00000448477
MVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARA

SEQ ID NO: 23044 - protein, 600 aa, Homo sapiens
  Payload ID: 4603
  Gene Symbol: DDX55
  Gene Name: DEAD (Asp-Glu-Ala-Asp) box polypeptide 55
  Uniprot ID: Q8NHQ9
  ENSP ID: ENSP00000238146
MEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSGILVCTDVMARGIDIPEVNWVLQYDPPSNASAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 23045 - protein, 191 aa, Homo sapiens
  Payload ID: 4603
  Gene Symbol: DDX55
  Gene Name: DEAD (Asp-Glu-Ala-Asp) box polypeptide 55
  ENSP ID: ENSP00000346244
MEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEARRRKWRTW

SEQ ID NO: 23046 - protein, 207 aa, Homo sapiens
  Payload ID: 4603
  Gene Symbol: DDX55
  Gene Name: DEAD (Asp-Glu-Ala-Asp) box polypeptide 55
  Uniprot ID: Q8NHQ9
  ENSP ID: ENSP00000442332
MKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 23047 - protein, 50 aa, Homo sapiens
  Payload ID: 4603
  Gene Symbol: DDX55
  Gene Name: DEAD (Asp-Glu-Ala-Asp) box polypeptide 55
  ENSP ID: ENSP00000442823
MEHVTEGSWESLPVPLHPQVLGALRELGFPYMTPVQPDSLDRRQESWRRC

SEQ ID NO: 23048 - protein, 569 aa, Homo sapiens
  Payload ID: 4603
  Gene Symbol: DDX55
  Gene Name: DEAD (Asp-Glu-Ala-Asp) box polypeptide 55
  ENSP ID: ENSP00000443114
MEHVTEGSWESLPVPLHPQVLGALRELGFPYMTPVQSATIPLFMRNKDVAAEAVTGSGKTLAFVIPILEILLRREEKLKKSQVGAIIITPTRELAIQIDEVLSHFTKHFPEFSQILWIGGRNPGEDVERFKQQGGNIIVATPGRLEDMFRRKAEGLDLASCVRSLDVLVLDEADRLLDMGFEASINTILEFLPKQRRTGLFSATQTQEVENLVRAGLRNPVRVSVKEKGVAASSAQKTPSRLENYYMVCKADEKFNQLVHFLRNHKQEKHLVFFSTCACVEYYGKALEVLVKGVKIMCIHGKMKYKRNKIFMEFRKLQSAFVHRCGRTARIGHGGSALVFLLPMEESYINFLAINQKCPLQEMKPQRNTADLLPKLKSMALADRAVFEKGMKAFVSYVQAYAKHECNLIFRLKDLDFASLARGFALLRMPKMPELRGKQFPDFVPVDVNTDTIPFKDKIREKQRQKLLEQQRREKTENEGRRKFIKNKAWSKQKAKKEKKKKMNEKRKREEGSDIEDEDMEELLNDTRLLKKLKKGKITEEEFEKGLLTTGKRTIKTVDLGISDLEDDC

SEQ ID NO: 23049 - protein, 42 aa, Homo sapiens
  Payload ID: 4603
  Gene Symbol: DDX55
  Gene Name: DEAD (Asp-Glu-Ala-Asp) box polypeptide 55
  ENSP ID: ENSP00000446255
MEHVTEGSWESLPVPLHPQVLGALRELGFPYMTPVQGFGSHL

SEQ ID NO: 23050 - protein, 722 aa, Homo sapiens
  Payload ID: 4604
  Gene Symbol: DDX58
  Gene Name: DEAD (Asp-Glu-Ala-Asp) box polypeptide 58
  ENSP ID: ENSP00000369197
METSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 23051 - protein, 925 aa, Homo sapiens
  Payload ID: 4604
  Gene Symbol: DDX58
  Gene Name: DEAD (Asp-Glu-Ala-Asp) box polypeptide 58
  Uniprot ID: O95786
  ENSP ID: ENSP00000369213
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 23052 - protein, 619 aa, Homo sapiens
  Payload ID: 4605
  Gene Symbol: DDX59
  Gene Name: DEAD (Asp-Glu-Ala-Asp) box polypeptide 59
  Uniprot ID: Q5T1V6
  ENSP ID: ENSP00000330460
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 23053 - protein, 160 aa, Homo sapiens
  Payload ID: 4605
  Gene Symbol: DDX59
  Gene Name: DEAD (Asp-Glu-Ala-Asp) box polypeptide 59
  ENSP ID: ENSP00000391312
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPES

SEQ ID NO: 23054 - protein, 205 aa, Homo sapiens
  Payload ID: 4605
  Gene Symbol: DDX59
  Gene Name: DEAD (Asp-Glu-Ala-Asp) box polypeptide 59
  ENSP ID: ENSP00000394304
FQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQLNIIWVVPFSGININASLIALLYSLLTTINMKFTP

SEQ ID NO: 23055 - protein, 580 aa, Homo sapiens
  Payload ID: 4605
  Gene Symbol: DDX59
  Gene Name: DEAD (Asp-Glu-Ala-Asp) box polypeptide 59
  Uniprot ID: Q5T1V6
  ENSP ID: ENSP00000394367
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQENTYKSTWRNPQHFQQDVRMTLGYVGKAQWEEDNQLKVKLGLKKNCSS

SEQ ID NO: 23056 - protein, 75 aa, Homo sapiens
  Payload ID: 4605
  Gene Symbol: DDX59
  Gene Name: DEAD (Asp-Glu-Ala-Asp) box polypeptide 59
  ENSP ID: ENSP00000398152
MLKMGFQQQVLDILENIPNDCQTILVSATIPTSIEQLASQLLHNPVRIITGEKNLPCANVRQIILWVEDPAKKKK

SEQ ID NO: 23057 - protein, 197 aa, Homo sapiens
  Payload ID: 4605
  Gene Symbol: DDX59
  Gene Name: DEAD (Asp-Glu-Ala-Asp) box polypeptide 59
  ENSP ID: ENSP00000408662
  MOD_RES (1)..(1): Any amino acid
XLPLPPQLYRLQQHVKDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 23058 - protein, 224 aa, Homo sapiens
  Payload ID: 4605
  Gene Symbol: DDX59
  Gene Name: DEAD (Asp-Glu-Ala-Asp) box polypeptide 59
  ENSP ID: ENSP00000409954
MLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYL

SEQ ID NO: 23059 - protein, 94 aa, Homo sapiens
  Payload ID: 4605
  Gene Symbol: DDX59
  Gene Name: DEAD (Asp-Glu-Ala-Asp) box polypeptide 59
  ENSP ID: ENSP00000416331
  MOD_RES (1)..(1): Any amino acid
XQKITGLKSISIHSEKSQIERKNILKGLLEGDYEVVVSTGVLGRGLDLISVRLVVNFDMPSSMDEYVHQSTHHNQYEVYSINRGMVQEVTCHPR

SEQ ID NO: 23060 - protein, 1712 aa, Homo sapiens
  Payload ID: 4606
  Gene Symbol: DDX60
  Gene Name: DEAD (Asp-Glu-Ala-Asp) box polypeptide 60
  Uniprot ID: Q8IY21
  ENSP ID: ENSP00000377344
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDVRTTFSRCLSKEWGSFLEESYPYFLIVADEGLNDLQTQLFNFLIIHSWARKVNVVLSSGQESDVLCLYAYLLPSMYRHQIFSWKNKQNIKDAYTTLLNQLERFKLSALAPLFGSLKWNNITEEAHKTVSLLTQVWPEGSDIRRVFCVTSCSLSLRMYHRFLGNREPSSGQETEIQQVNSNCLTLQEMEDLCKLHCLTVVFLLHLPLSQRACARVITSHWAEDMKPLLQMKKWCEYFILRNIHTFEFWNLNLIHLSDLNDELLLKNIAFYYENENVKGLHLNLGDTIMKDYEYLWNTVSKLVRDFEVGQPFPLRTTKVCFLEKKPSPIKDSSNEMVPNLGFIPTSSFVVDKFAGDILKDLPFLKSDDPIVTSLVKQKEFDELVHWHSHKPLSDDYDRSRCQFDEKSRDPRVLRSVQKYHVFQRFYGNSLETVSSKIIVTQTIKSKKDFSGPKSKKAHETKAEIIARENKKRLFAREEQKEEQKWNALSFSIEEQLKENLHSGIKSLEDFLKSCKSSCVKLQVEMVGLTACLKAWKEHCRSEEGKTTKDLSIAVQVMKRIHSLMEKYSELLQEDDRQLIARCLKYLGFDELASSLHPAQDAENDVKVKKRNKYSVGIGPARFQLQYMGHYLIRDERKDPDPRVQDFIPDTWQRELLDVVDKNESAVIVAPTSSGKTYASYYCMEKVLKESDDGVVVYVAPTKALVNQVAATVQNRFTKNLPSGEVLCGVFTREYRHDALNCQVLITVPACFEILLLAPHRQNWVKKIRYVIFDEVHCLGGEIGAEIWEHLLVMIRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDHIERYGFPPDLTLSPRESIQLYDAMFQIWKSWPRAQELCPENFIHFNNKLVIKKMDARKYEESLKAELTSWIKNGNVEQARMVLQNLSPEADLSPENMITMFPLLVEKLRKMEKLPALFFLFKLGAVENAAESVSTFLKKKQETKRPPKADKEAHVMANKLRKVKKSIEKQKIIDEKSQKKTRNVDQSLIHEAEHDNLVKCLEKNLEIPQDCTYADQKAVDTETLQKVFGRVKFERKGEELKALAERGIGYHHSAMSFKEKQLVEILFRKGYLRVVTATGTLALGVNMPCKSVVFAQNSVYLDALNYRQMSGRAGRRGQDLMGDVYFFDIPFPKIGKLIKSNVPELRGHFPLSITLVLRLMLLASKGDDPEDAKAKVLSVLKHSLLSFKQPRVMDMLKLYFLFSLQFLVKEGYLDQEGNPMGFAGLVSHLHYHEPSNLVFVSFLVNGLFHDLCQPTRKGSKHFSQDVMEKLVLVLAHLFGRRYFPPKFQDAHFEFYQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSISVSLRELCENEDDNVVLAFEQLSTTFWEKLNKV

SEQ ID NO: 23061 - protein, 191 aa, Homo sapiens
  Payload ID: 4606
  Gene Symbol: DDX60
  Gene Name: DEAD (Asp-Glu-Ala-Asp) box polypeptide 60
  ENSP ID: ENSP00000422669
  MOD_RES (1)..(1): Any amino acid
XQSKVFLDDLPEDFSDALDEYNMKIMEDFTTFLRIVSKLADMNQEYQLPLSKIKFTGKECEDSQLVSHLMSCKEGRVAISPFVCLSGNFDDDLLRLETPNHVTLGTIGVNRSQAPVLLSQKFDNRGRKMSLNAYALDFYKHGSLIGLVQDNRMNEGDAYYLLKDFALTIKSIRCVIYLNIDFRFFNNLFII

SEQ ID NO: 23062 - protein, 119 aa, Homo sapiens
  Payload ID: 4606
  Gene Symbol: DDX60
  Gene Name: DEAD (Asp-Glu-Ala-Asp) box polypeptide 60
  ENSP ID: ENSP00000423647
MERNVLTTFSQEMSQLILNEMPKAEYSSLFNDFVESEFFLIDGDSLLITCICEISFKPGQNLHFFYLVERYLVDLISKGGQFTIVFFKDAEYAYFNFPELLSLRTALILHLQKNTTIDV

SEQ ID NO: 23063 - protein, 104 aa, Homo sapiens
  Payload ID: 4606
  Gene Symbol: DDX60
  Gene Name: DEAD (Asp-Glu-Ala-Asp) box polypeptide 60
  ENSP ID: ENSP00000423678
  MOD_RES (1)..(1): Any amino acid
XRCPFLALSATISNPEHLTEWLQSVKWYWKQEDKIIENNTASKRHVGRQAGFPKDYLQVKQSYKVRLVLYGERYNDLEKHVCSIKHGDIHFDHFHPCAALTTDH

SEQ ID NO: 23064 - protein, 1706 aa, Homo sapiens
  Payload ID: 4607
  Gene Symbol: DDX60L
  Gene Name: DEAD (Asp-Glu-Ala-Asp) box polypeptide 60-like
  Uniprot ID: Q5H9U9
  ENSP ID: ENSP00000260184
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFSGCLSQDWKLFLEQHYPYFLIVSEEGLSDLQTYLFNFLIIHSWGMKVNVVLSSGHESDTLRFYAYTMESTDRNQTFSKENETVIQSAYKSLIQHLEEIRVLVLATHFEHLKWNDMMEEAYQTLFLLQHLWSEGSDIQRVLCVTSCSLSLRMYHRVLVHSNCLSLQEVEDFCRLRCLCVAFQLHLPLSQRACSRVITCSWIRNSDSFLKMNKWCEYFILSNLNVFGCWNLNLNHVSDLYDEQLLKNIAFYYEFESTQEPHLNLGDSIRRDYEDLWNVVSHLVKEFNVGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYCHNVLNCQVLITVPECFEILLLAPHRQKWVERIRYVIFDEVHYLGREVGAKFWELLLVIIRCPFLVLSATINNPNLLTKWLQSVKQYWKQADKIMEEKCISEKQADKCLNFLQDHSYKNQSYEVRLVLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKNPKKAEKLERKKVYRAEYINFLENLKILEISEDCTYADVKALHTEITRNKDSTLERVLPRVRFTRHGKELKALAQRGIGYHHSSMYFKEKEFVEILFVKGLIRVVTATETLALGIHMPCKSVVFAQDSVYLDALNYRQMSGRAGRRGQDLLGNVYFFDIPLPKIKRLLASSVPELRGQFPLSITLVLRLMLLASKGDDPEDAKAKVLSVLKHSLLSFKRRRAMETLKLYFLFSLQLLIKEDYLNKKGNPKKFAGLASYLHGHEPSNLVFVNFLKRGLFHNLCKPAWKGSQQFSQDVMEKLVLVLANLFGRKYIPAKFQNANLSFSQSKVILAELPEDFKAALYEYNLAVMKDFASFLLIASKSVNMKKEHQLPLSRIKFTGKECEDSQLVSHLMSCKKGRVAISPFVCLSGNTDNDLLRPETINQVILRTVGVSGTQAPLLWPWKLDNRGRRMPLNAYVLNFYKHNCLTRLDQKNGMRMGQLLKCLKDFAFNIQAISDSLSELCENKRDNVVLAFKQLSQTFYEKLQEMQIQMSQNHLE

SEQ ID NO: 23065 - protein, 868 aa, Homo sapiens
  Payload ID: 4607
  Gene Symbol: DDX60L
  Gene Name: DEAD (Asp-Glu-Ala-Asp) box polypeptide 60-like
  ENSP ID: ENSP00000421026
RMYHRVLVHSNCLSLQEVEDFCRLRCLCVAFQLHLPLSQRACSRVITCSWIRNSDSFLKMNKWCEYFILSNLNVFGCWNLNLNHVSDLYDEQLLKNIAFYYEFESTQEPHLNLGDSIRRDYEDLWNVVSHLVKEFNVGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYCHNVLNCQVHYLGREVGAKFWELLLVIIRCPFLVLSATINNPNLLTKWLQSVKQYWKQADKIMEEKCISEKQADKCLNFLQDHSYKNQSYEVRLVLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKNPKKA

SEQ ID NO: 23066 - protein, 1308 aa, Homo sapiens
  Payload ID: 4607
  Gene Symbol: DDX60L
  Gene Name: DEAD (Asp-Glu-Ala-Asp) box polypeptide 60-like
  Uniprot ID: Q5H9U9
  ENSP ID: ENSP00000422202
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFSGCLSQDWKLFLEQHYPYFLIVSEEGLSDLQTYLFNFLIIHSWGMKVNVVLSSGHESDTLRFYAYTMESTDRNQTFSKENETVIQSAYKSLIQHLEEIRVLVLATHFEHLKWNDMMEEAYQTLFLLQHLWSEGSDIQRVLCVTSCSLSLRMYHRVLVHSNCLSLQEVEDFCRLRCLCVAFQLHLPLSQRACSRVITCSWIRNSDSFLKMNKWCEYFILSNLNVFGCWNLNLNHVSDLYDEQLLKNIAFYYEFESTQEPHLNLGDSIRRDYEDLWNVVSHLVKEFNVGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYCHNVLNCQVLITVPECFEILLLAPHRQKWVERIRYVIFDEVHYLGREVGAKFWELLLVIIRCPFLVLSATINNPNLLTKWLQSVKQYWKQADKIMEEKCISEKQADKCLNFLQDHSYKNQSYEVRLVLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRISTKKNPKKAEKLERKKVYRAEYINFLENLKILEISEDCTYADVKALHTEITRNKDSTLERVLPRVRFTRHGKELKALAQRGIGYHHSSMYFKEKEFVEILFVKGLIRVVTATETLALGIHMPCKSVVFAQDSVYLDALNYRQIM

SEQ ID NO: 23067 - protein, 1706 aa, Homo sapiens; identical to SEQ ID NO: 23064
  Payload ID: 4607
  Gene Symbol: DDX60L
  Gene Name: DEAD (Asp-Glu-Ala-Asp) box polypeptide 60-like
  Uniprot ID: Q5H9U9
  ENSP ID: ENSP00000422423

SEQ ID NO: 23068 - protein, 195 aa, Homo sapiens
  Payload ID: 4607
  Gene Symbol: DDX60L
  Gene Name: DEAD (Asp-Glu-Ala-Asp) box polypeptide 60-like
  ENSP ID: ENSP00000422920
  MOD_RES (1)..(1): Any amino acid
XFKNDDVGKRAGSVCTFLEKTETKSHPHTECHSYVFAIDEVLEKVRKTQKRITKKNPKKAEKLERKKVYRAEYINFLENLKILEISEDCTYADVKALHTEITRNKDSTLERVLPRVRFTRHGKELKALAQRGIGYHHSSMYFKEKEFVEILFVKGLIRVVTATETLALGIHMPCKSVVFAQDSVYLDALNYRQIM

SEQ ID NO: 23069 - protein, 124 aa, Homo sapiens
  Payload ID: 4607
  Gene Symbol: DDX60L
  Gene Name: DEAD (Asp-Glu-Ala-Asp) box polypeptide 60-like
  ENSP ID: ENSP00000424310
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFPELLSLRTALILHLQHNTNIDVQTEFS

SEQ ID NO: 23070 - protein, 98 aa, Homo sapiens
  Payload ID: 4607
  Gene Symbol: DDX60L
  Gene Name: DEAD (Asp-Glu-Ala-Asp) box polypeptide 60-like
  ENSP ID: ENSP00000424396
MGSKDHAVFFREMTQLILNEMPKAGYSSILNDFVESNFFVIDGDSLLVTCLGVKSFKWGQNLHFFYLVECYLVDLLSNGGQFTIVFFKDAEYAYFDFP

SEQ ID NO: 23071 - protein, 77 aa, Homo sapiens
  Payload ID: 4607
  Gene Symbol: DDX60L
  Gene Name: DEAD (Asp-Glu-Ala-Asp) box polypeptide 60-like
  ENSP ID: ENSP00000427386
MGSKDHAVFFREMTQLILNEMPKAGYSSILNDFVESNFFVIDGDSLLVTCLGVKSFKWGQNLHFFYLVECYLVDLLS

SEQ ID NO: 23072 - protein, 880 aa, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENSP ID: ENSP00000228264
MAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIQGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASVVLLDQRYARPPVLAKLPAWIRARVEVKATFGPAIAAVQKFHREKSASS

SEQ ID NO: 23073 - protein, 856 aa, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENSP ID: ENSP00000309965
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIQGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASVVLLDQRYARPPVLAKLPAWIRARVEVKATFGPAIAAVQKFHREKSASS

SEQ ID NO: 23074 - protein, 224 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000406457
MAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSP

SEQ ID NO: 23075 - protein, 288 aa, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENSP ID: ENSP00000406799
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRAPSDATSSRHPPDASFPAALNFLQRTRPSSVLSEDLLMQRAVAKHPALLPWQMSSSPLRPGSEWMRMRMTWRKNT

SEQ ID NO: 23076 - protein, 302 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000407646
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEAL

SEQ ID NO: 23077 - protein, 78 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000439298
MANETQKVGAIHFPFPFTPYSIQEDFMAELYRVLEAGKIGIFESPTGTGLQAPRGLLENRPGLLSLCRRKKRGTWWTD

SEQ ID NO: 23078 - protein, 191 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000440171
MPLDGVRDSGMASRGPAAKDGENMVSASQKKGEIWSMANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKY

SEQ ID NO: 23079 - protein, 970 aa, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENSP ID: ENSP00000440402
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIQGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLSPRPGTPREGSGGEPVHEGRQPVHRQGHQAPEGFCQRSAPGPAICPAPCPGQAAGLDPSPCGGQSYLWPRHCCCAEVSPGEVGLFLMGNHTTAWRRALPLSCPLETVFVVGVVCGDPVTKVKPRRRVWSPECCQDPGTGVSSRRRKWGNPE

SEQ ID NO: 23080 - protein, 172 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000441015
  MOD_RES (1)..(1): Any amino acid
XQVEQVLLAYSRCIQVRASCWAWACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASVVLLDQRYARPPVLAKLPAWIRARVEVKATFGPAIAAVQKFHREKSASS

SEQ ID NO: 23081 - protein, 171 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000441425
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLKLGCEWLRRGS

SEQ ID NO: 23082 - protein, 304 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000442466
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQRRRKELRRRSQRGGGRRSRQPAPSTTTSRWAFSGMRPWQR

SEQ ID NO: 23083 - protein, 906 aa, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENSP ID: ENSP00000443426
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIQGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLPRAPGQAPPGKALVENLCMKAVNQSIGRAIRHQKDFASVVLLDQRYARPPVLAKLPAWIRARVEVKATFGPAIAAVQKFHREKSASS

SEQ ID NO: 23084 - protein, 288 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000443578
MAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHVAVLSVFSLCACATLREEERS

SEQ ID NO: 23085 - protein, 76 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000443750
  MOD_RES (1)..(1): Any amino acid
XQVEQVLLAYSRCIQACGQERGQVTGALLLSVVGGKMSEGINFSDNLGRSAELQEKMAYLDQTLAGPSGTRRILPA

SEQ ID NO: 23086 - protein, 31 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000445219
LICGALSWLRDFEQKKRDRGPAPLCGWRKDE

SEQ ID NO: 23087 - protein, 297 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000445568
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEERS

SEQ ID NO: 23088 - protein, 91 aa, Homo sapiens
  Payload ID: 4608
  Gene Symbol: DDX11
  Gene Name: DEAD/H (Asp-Glu-Ala-Asp/His) box helicase 11
  ENSP ID: ENSP00000473610
ESPTGTGKSLSLICGALSWLRDFEQKKREEEARLLETGTGPLHDEKDESLCLSSSCEGAAGTPRPAGEPAWVTQFVQKKEERDLVDRLKSG

SEQ ID NO: 23089 - protein, 861 aa, Homo sapiens
  Payload ID: 4609
  Gene Symbol: DDX26B
  Gene Name: DEAD/H (Asp-Glu-Ala-Asp/His) box polypeptide 26B
  Uniprot ID: Q5JSJ4
  ENSP ID: ENSP00000359788
MPILLFLIDTSASMNQRTDLGTSYLDIAKGAVELFLKLRARDPASRGDRYMLVTYDEPPYCIKAGWKENHATFMSELKNLQASGLTTLGQALRSSFDLLNLNRLISGIDNYGQGRNPFFLEPSILITITDGNKLTSTAGVQEELHLPLNSPLPGSELTKEPFRWDQRLFALVLRLPGVASTEPEQLGSVPTDESAITQMCEVTGGRSYCVRTQRMLNQCLESLVQKVQSGVVINFEKTGPDPLPIGEDGLMDSSRPSNSFAAQPWHSCHKLIYVRPNSKTGVPVGHWPIPESFWPDQNLPSLPPRTSHPVVRFSCVDCEPMVIDKLPFDKYELEPSPLTQYILERKSPHTCWQVFVTSSGKYNELGYPFGYLKASTTLTCVNLFVMPYNYPVLLPLLDDLFKVHKLKPNLKWRQAFDSYLKTLPPYYLLTKLESERILASVGKKPPQEIGIKVKNHSGGGMSLTHNKNFRKLLKEITGETALRLTELNTKEFAGFQIGLLNKDLKPQTYRNAYDIPRRGLLDQLTRMRSNLLKTHKFIVGQDEDSLHSVPVAQMGNYQEYLKTLASPLREIDPDQPKRLHTFGNPFKQDKKGMMIDEADEFVAGPQNKVKRPGEPNSPMSSKRRRSMSLLLRKPQTPPTVTNHVGGKGPPSASWFPSYPNLIKPTLVHTDATIIHDGHEEKMENGQITPDGFLSKSAPSELINMTGDLMPPNQVDSLSDDFTSLSKDGLIQKPGSNAFVGGAKNCSLSVDDQKDPVASTLGAMPNTLQITPAMAQGINADIKHQLMKEVRKFGRKYERIFILLEEVQGPLEMKKQFVEFTIKEAARFKRRVLIQYLEKVLEKINSHHLHNNISHINSRSSC

SEQ ID NO: 23090 - protein, 565 aa, Homo sapiens
  Payload ID: 4610
  Gene Symbol: DEAF1
  Gene Name: DEAF1 transcription factor
  Uniprot ID: O75398
  ENSP ID: ENSP00000371846
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 23091 - protein, 349 aa, Homo sapiens
  Payload ID: 4610
  Gene Symbol: DEAF1
  Gene Name: DEAF1 transcription factor
  ENSP ID: ENSP00000431563
  MOD_RES (1)..(1): Any amino acid
XLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 23092 - protein, 86 aa, Homo sapiens
  Payload ID: 4610
  Gene Symbol: DEAF1
  Gene Name: DEAF1 transcription factor
  ENSP ID: ENSP00000432518
  MOD_RES (1)..(1): Any amino acid
XPVLSRDEDSEEDADSEAERETPRVTAVAVMAAEPGHMDMGAEALPGPDEAAAAAAFAGKCARRPLASSGSRAPTPRACPAQLSQR

SEQ ID NO: 23093 - protein, 161 aa, Homo sapiens
  Payload ID: 4610
  Gene Symbol: DEAF1
  Gene Name: DEAF1 transcription factor
  ENSP ID: ENSP00000487909
  MOD_RES (1)..(1): Any amino acid
XLTSLPALAVPPPTPTKTAPPALVNGLELSEPRSWLYLEEMVNSLLNTAQQLKTLFEQAKHASTYREAATNQAKIHADAERKEVIHPPRLPKVLGLQQSCVNCGREAMSECTGCHKVNYCSTFCQRKDWKDHQHICGQSAAVTVQADEVHVAESVMEKVTV

SEQ ID NO: 23094 - protein, 147 aa, Homo sapiens
  Payload ID: 4610
  Gene Symbol: DEAF1
  Gene Name: DEAF1 transcription factor
  ENSP ID: ENSP00000488285
  MOD_RES (1)..(1): Any amino acid
XLTSLPALAVPPPTPTKTAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 23095 - protein, 143 aa, Homo sapiens
  Payload ID: 4610
  Gene Symbol: DEAF1
  Gene Name: DEAF1 transcription factor
  ENSP ID: ENSP00000488313
  MOD_RES (1)..(1): Any amino acid
XLTSLPALAVPPPTPTKTAPPALVNGLELSEPRSWLYLEEMVNSLLNTAQQLKTLFEQAKHASTYREAATNQAKIHADAERKEQSCVNCGREAMSECTGCHKVNYCSTFCQRKRWSLTMLTSLVSISWLRAILPCQPPKVLGL

SEQ ID NO: 23096 - protein, 496 aa, Homo sapiens
  Payload ID: 4611
  Gene Symbol: DFNA5
  Gene Name: deafness, autosomal dominant 5
  Uniprot ID: O60443
  ENSP ID: ENSP00000339587
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 23097 - protein, 496 aa, Homo sapiens; identical to SEQ ID NO: 23096
  Payload ID: 4611
  Gene Symbol: DFNA5
  Gene Name: deafness, autosomal dominant 5
  Uniprot ID: O60443
  ENSP ID: ENSP00000386670

SEQ ID NO: 23098 - protein, 332 aa, Homo sapiens
  Payload ID: 4611
  Gene Symbol: DFNA5
  Gene Name: deafness, autosomal dominant 5
  Uniprot ID: O60443
  ENSP ID: ENSP00000387119
MQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 23099 - protein, 155 aa, Homo sapiens
  Payload ID: 4611
  Gene Symbol: DFNA5
  Gene Name: deafness, autosomal dominant 5
  ENSP ID: ENSP00000389874
  MOD_RES (1)..(1): Any amino acid
XAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVKDILGRSSSLTLSCTNGESHTSCQPSSHPDSVSSLS

SEQ ID NO: 23100 - protein, 55 aa, Homo sapiens
  Payload ID: 4611
  Gene Symbol: DFNA5
  Gene Name: deafness, autosomal dominant 5
  ENSP ID: ENSP00000395540
QLFMTAYFLVSALAEMPDSAAALLGTCCKLQIIPTLCHLVSNLPGGTLEWIGMGK

SEQ ID NO: 23101 - protein, 192 aa, Homo sapiens
  Payload ID: 4611
  Gene Symbol: DFNA5
  Gene Name: deafness, autosomal dominant 5
  ENSP ID: ENSP00000398445
  MOD_RES (1)..(1): Any amino acid
XEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVQKDILGRSSSLTLSCTNGESHTSCQPSSHPDSVSSLS

SEQ ID NO: 23102 - protein, 332 aa, Homo sapiens; identical to SEQ ID NO: 23098
  Payload ID: 4611
  Gene Symbol: DFNA5
  Gene Name: deafness, autosomal dominant 5
  Uniprot ID: O60443
  ENSP ID: ENSP00000401332

SEQ ID NO: 23103 - protein, 18 aa, Homo sapiens
  Payload ID: 4611
  Gene Symbol: DFNA5
  Gene Name: deafness, autosomal dominant 5
  ENSP ID: ENSP00000413963
MQKCVISEHMQVEEKCGG

SEQ ID NO: 23104 - protein, 216 aa, Homo sapiens
  Payload ID: 4611
  Gene Symbol: DFNA5
  Gene Name: deafness, autosomal dominant 5
  ENSP ID: ENSP00000414090
VKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFAPLCLPWWSCPVLLMASGECVTPPQLTESSAFSEGSKVASRTRRELTLSTWTPWSFESLHS

SEQ ID NO: 23105 - protein, 524 aa, Homo sapiens
  Payload ID: 4612
  Gene Symbol: DFNB31
  Gene Name: deafness, autosomal recessive 31
  ENSP ID: ENSP00000265134
MANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 23106 - protein, 907 aa, Homo sapiens
  Payload ID: 4612
  Gene Symbol: DFNB31
  Gene Name: deafness, autosomal recessive 31
  ENSP ID: ENSP00000354623
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 23107 - protein, 345 aa, Homo sapiens
  Payload ID: 4612
  Gene Symbol: DFNB31
  Gene Name: deafness, autosomal recessive 31
  Uniprot ID: Q9P202
  ENSP ID: ENSP00000363170
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVSGVGKGGQPLRHRILPPNPEQQSCLEAARRGWFCPGSVFPQVCTEGWCFFFAFLFDLCSVCYNTG

SEQ ID NO: 23108 - protein, 556 aa, Homo sapiens
  Payload ID: 4612
  Gene Symbol: DFNB31
  Gene Name: deafness, autosomal recessive 31
  ENSP ID: ENSP00000363172
MHGSLEALLFLPQVTLSLAHAHLICSNAQLEMCVFPHRFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 23109 - protein, 352 aa, Homo sapiens
  Payload ID: 4613
  Gene Symbol: DFNB59
  Gene Name: deafness, autosomal recessive 59
  Uniprot ID: Q0ZLH3
  ENSP ID: ENSP00000364271
MFAAATKSFVKQVGDGGRLVPVPSLSEADKYQPLSLVVKKKRCFLFPRYKFTSTPFTLKDILLGDREISAGISSYQLLNYEDESDVSLYGRRGNHIVNDVGINVAGSDSIAVKASFGIVTKHEVEVSTLLKEITTRKINFDHSLIRQSRSSRKAVLCVVMESIRTTRQCSLSVHAGIRGEAMRFHFMDEQNPKGRDKAIVFPAHTTIAFSVFELFIYLDGAFDLCVTSVSKGGFEREETATFALLYRLRNILFERNRRVMDVISRSQLYLDDLFSDYYDKPLSMTDISLKEGTHIRVNLLNHNIPKGPCILCGMGNFKRETVYGCFQCSVDGQKYVRLHAVPCFDIWHKRMK

SEQ ID NO: 23110 - protein, 352 aa, Homo sapiens; identical to SEQ ID NO: 23109
  Payload ID: 4613
  Gene Symbol: DFNB59
  Gene Name: deafness, autosomal recessive 59
  Uniprot ID: Q0ZLH3
  ENSP ID: ENSP00000386647

SEQ ID NO: 23111 - protein, 105 aa, Homo sapiens
  Payload ID: 4613
  Gene Symbol: DFNB59
  Gene Name: deafness, autosomal recessive 59
  ENSP ID: ENSP00000399579
  MOD_RES (1)..(1): Any amino acid
XKHEVEVSTLLKEITTRKINFDHSLIRQSRSSRKAVLCVVMESIRTTRQCSLSVHAGIRGEAMRFHFMDEQNPKGRDKAIVFPAHTTIAFSVFELFIYLDGAFGL

SEQ ID NO: 23112 - protein, 156 aa, Homo sapiens
  Payload ID: 4613
  Gene Symbol: DFNB59
  Gene Name: deafness, autosomal recessive 59
  ENSP ID: ENSP00000410776
  MOD_RES (1)..(1): Any amino acid
XTPFTLKDILLGDREISAGISSYQLLNYEDESDVSLYGRRGNHIVNDVGINVAGSDSIAVKASFGIVTKHEVEVSTLLKEITTRKINFDHSLIRQSRSSRKAVLCVVMESIRTTRQCSLSVHAGIRGEAMRTFVSLQCQKEDLKGKKRQHLHCCTG

SEQ ID NO: 23113 - protein, 51 aa, Homo sapiens
  Payload ID: 4614
  Gene Symbol: DHX57
  Gene Name: DEAH (Asp-Glu-Ala-Asp/His) box polypeptide 57
  ENSP ID: ENSP00000387404
KKLEFAFANSDYLALLQAYKGWQLSTKEGVRASYNYCRQNFLSGRVLQEKR

SEQ ID NO: 23114 - protein, 665 aa, Homo sapiens
  Payload ID: 4614
  Gene Symbol: DHX57
  Gene Name: DEAH (Asp-Glu-Ala-Asp/His) box polypeptide 57
  ENSP ID: ENSP00000397841
  MOD_RES (1)..(1): Any amino acid
XDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVRHFDSPYLLYHEKIKTSRVFIRDCSMVSVYPLVLFGGGQVNVQLQRGEFVVSLDDGWIRFVAASHQVAELVKELRCELDQLLQDKIKNPSIDLCTCPRGSRIISTIVKLVTTQ

SEQ ID NO: 23115 - protein, 1386 aa, Homo sapiens
  Payload ID: 4614
  Gene Symbol: DHX57
  Gene Name: DEAH (Asp-Glu-Ala-Asp/His) box polypeptide 57
  Uniprot ID: Q6P158
  ENSP ID: ENSP00000405111
MSSSVRRKGKPGKGGGKGSSRGGRGGRSHASKSHGSGGGGGGGGGGGGGNRKASSRIWDDGDDFCIFSESRRPSRPSNSNISKGESRPKWKPKAKVPLQTLHMTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKASESEESDEDDGPAPVIVENESYVNLKKKISKRYDWQAKSVHAENGKICKQFRMKQASRQFQSILQERQSLPAWEERETILNLLRKHQVVVISGMTGCGKTTQIPQFILDDSLNGPPEKVANIICTQPRRISAISVAERVAKERAERVGLTVGYQIRLESVKSSATRLLYCTTGVLLRRLEGDTALQGVSHIIVDEVHERTEESDFLLLVLKDIVSQRPGLQVILMSATLNAELFSDYFNSCPVITIPGRTFPVDQFFLEDAIAVTRYVLQDGSPYMRSMKQISKEKLKARRNRTAFEEVEEDLRLSLHLQDQDSVKDAVPDQQLDFKQLLARYKGVSKSVIKTMSIMDFEKVNLELIEALLEWIVDGKHSYPPGAILVFLPGLAEIKMLYEQLQSNSLFNNRRSNRCVIHPLHSSLSSEEQQAVFVKPPAGVTKIIISTNIAETSITIDDVVYVIDSGKMKEKRYDASKGMESLEDTFVSQANALQRKGRAGRVASGVCFHLFTSHHYNHQLLKQQLPEIQRVPLEQLCLRIKILEMFSAHNLQSVFSRLIEPPHTDSLRASKIRLRDLGALTPDERLTPLGYHLASLPVDVRIGKLMLFGSIFRCLDPALTIAASLAFKSPFVSPWDKKEEANQKKLEFAFANSDYLALLQAYKGWQLSTKEGVRASYNYCRQNFLSGRVLQEMASLKRQFTELLSDIGFAREGLRAREIEKRAQGGDGVLDATGEEANSNAENPKLISAMLCAALYPNVVQVKSPEGKFQKTSTGAVRMQPKSAELKFVTKNDGYVHIHPSSVNYQVRHFDSPYLLYHEKIKTSRVFIRDCSMVSVYPLVLFGGGQVNVQLQRGEFVVSLDDGWIRFVAASHQVAELVKELRCELDQLLQDKIKNPSIDLCTCPRGSRIISTIVKLVTTQ

SEQ ID NO: 23116 - protein, 106 aa, Homo sapiens
  Payload ID: 4614
  Gene Symbol: DHX57
  Gene Name: DEAH (Asp-Glu-Ala-Asp/His) box polypeptide 57
  ENSP ID: ENSP00000479840
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDG

SEQ ID NO: 23117 - protein, 472 aa, Homo sapiens
  Payload ID: 4614
  Gene Symbol: DHX57
  Gene Name: DEAH (Asp-Glu-Ala-Asp/His) box polypeptide 57
  ENSP ID: ENSP00000482275
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKASESEESDEDDGPAPVIVENESYVNLKKKISKRYDWQAKSVHAENGKICKQFRMKQASRQFQSILQERQSLPAWEERETILNLLRKHQVVVISGMTGTYLF

SEQ ID NO: 23118 - protein, 795 aa, Homo sapiens
  Payload ID: 4615
  Gene Symbol: DHX15
  Gene Name: DEAH (Asp-Glu-Ala-His) box helicase 15
  Uniprot ID: O43143
  ENSP ID: ENSP00000336741
MSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 23119 - protein, 1166 aa, Homo sapiens
  Payload ID: 4616
  Gene Symbol: DHX30
  Gene Name: DEAH (Asp-Glu-Ala-His) box helicase 30
  ENSP ID: ENSP00000343442
MCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 23120 - protein, 42 aa, Homo sapiens
  Payload ID: 4616
  Gene Symbol: DHX30
  Gene Name: DEAH (Asp-Glu-Ala-His) box helicase 30
  ENSP ID: ENSP00000379094
MFSLDSFRKDRAQHRQRQCKLPPPRLPPMCVNPTPGGTISRG

SEQ ID NO: 23121 - protein, 1194 aa, Homo sapiens
  Payload ID: 4616
  Gene Symbol: DHX30
  Gene Name: DEAH (Asp-Glu-Ala-His) box helicase 30
  Uniprot ID: Q7L2E3
  ENSP ID: ENSP00000392601
MFSLDSFRKDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 23122 - protein, 1222 aa, Homo sapiens
  Payload ID: 4616
  Gene Symbol: DHX30
  Gene Name: DEAH (Asp-Glu-Ala-His) box helicase 30
  Uniprot ID: Q7L2E3
  ENSP ID: ENSP00000394682
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 23123 - protein, 42 aa, Homo sapiens; identical to SEQ ID NO: 23120
  Payload ID: 4616
  Gene Symbol: DHX30
  Gene Name: DEAH (Asp-Glu-Ala-His) box helicase 30
  ENSP ID: ENSP00000395166

SEQ ID NO: 23124 - protein, 1194 aa, Homo sapiens; identical to SEQ ID NO: 23121
  Payload ID: 4616
  Gene Symbol: DHX30
  Gene Name: DEAH (Asp-Glu-Ala-His) box helicase 30
  Uniprot ID: Q7L2E3
  ENSP ID: ENSP00000405620

SEQ ID NO: 23125 - protein, 42 aa, Homo sapiens; identical to SEQ ID NO: 23120
  Payload ID: 4616
  Gene Symbol: DHX30
  Gene Name: DEAH (Asp-Glu-Ala-His) box helicase 30
  ENSP ID: ENSP00000410571

SEQ ID NO: 23126 - protein, 1155 aa, Homo sapiens
  Payload ID: 4616
  Gene Symbol: DHX30
  Gene Name: DEAH (Asp-Glu-Ala-His) box helicase 30
  Uniprot ID: Q7L2E3
  ENSP ID: ENSP00000483160
MAASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 23127 - protein, 1270 aa, Homo sapiens
  Payload ID: 4617
  Gene Symbol: DHX9
  Gene Name: DEAH (Asp-Glu-Ala-His) box helicase 9
  Uniprot ID: Q08211
  ENSP ID: ENSP00000356520
MGDVKNFLYAWCGKRKMTPSYEIRAVGNKNRQKFMCEVQVEGYNYTGMGNSTNKKDAQSNAARDFVNYLVRINEIKSEEVPAFGVASPPPLTDTPDTTANAEGDLPTTMGGPLPPHLALKAENNSEVGASGYGVPGPTWDRGANLKDYYSRKEEQEVQATLESEEVDLNAGLHGNWTLENAKARLNQYFQKEKIQGEYKYTQVGPDHNRSFIAEMTIYIKQLGRRIFAREHGSNKKLAAQSCALSLVRQLYHLGVVEAYSGLTKKKEGETVEPYKVNLSQDLEHQLQNIIQELNLEILPPPEDPSVPVALNIGKLAQFEPSQRQNQVGVVPWSPPQSNWNPWTSSNIDEGPLAFATPEQISMDLKNELMYQLEQDHDLQAILQERELLPVKKFESEILEAISQNSVVIIRGATGCGKTTQVPQFILDDFIQNDRAAECNIVVTQPRRISAVSVAERVAFERGEEPGKSCGYSVRFESILPRPHASIMFCTVGVLLRKLEAGIRGISHVIVDEIHERDINTDFLLVVLRDVVQAYPEVRIVLMSATIDTSMFCEYFFNCPIIEVYGRTYPVQEYFLEDCIQMTHFVPPPKDKKKKDKDDDGGEDDDANCNLICGDEYGPETRLSMSQLNEKETPFELIEALLKYIETLNVPGAVLVFLPGWNLIYTMQKHLEMNPHFGSHRYQILPLHSQIPREEQRKVFDPVPVGVTKVILSTNIAETSITINDVVYVIDSCKQKVKLFTAHNNMTNYATVWASKTNLEQRKGRAGRVRPGFCFHLCSRARFERLETHMTPEMFRTPLHEIALSIKLLRLGGIGQFLAKAIEPPPLDAVIEAEHTLRELDALDANDELTPLGRILAKLPIEPRFGKMMIMGCIFYVGDAICTIAAATCFPEPFINEGKRLGYIHRNFAGNRFSDHVALLSVFQAWDDARMGGEEAEIRFCEHKRLNMATLRMTWEAKVQLKEILINSGFPEDCLLTQVFTNTGPDNNLDVVISLLAFGVYPNVCYHKEKRKILTTEGRNALIHKSSVNCPFSSQDMKYPSPFFVFGEKIRTRAISAKGMTLVTPLQLLLFASKKVQSDGQIVLVDDWIKLQISHEAAACITGLRAAMEALVVEVTKQPAIISQLDPVNERMLNMIRQISRPSAAGINLMIGSTRYGDGPRPPKMARYDNGSGYRRGGSSYSGGGYGGGYSSGGYGSGGYGGSANSFRAGYGAGVGGGYRGVSRGGFRGNSGGDYRGPSGGYRGSGGFQRGGGRGAYGTGYFGQGRGGGGY

SEQ ID NO: 23128 - protein, 560 aa, Homo sapiens
  Payload ID: 4618
  Gene Symbol: DHX16
  Gene Name: DEAH (Asp-Glu-Ala-His) box polypeptide 16
  ENSP ID: ENSP00000365620
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 23129 - protein, 1041 aa, Homo sapiens
  Payload ID: 4618
  Gene Symbol: DHX16
  Gene Name: DEAH (Asp-Glu-Ala-His) box polypeptide 16
  Uniprot ID: O60231
  ENSP ID: ENSP00000365625
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 23130 - protein, 560 aa, Homo sapiens
  Payload ID: 4618
  Gene Symbol: DHX16
  Gene Name: DEAH (Asp-Glu-Ala-His) box polypeptide 16
  ENSP ID: ENSP00000373070
MESQPAQECLMQMFLPIEPACFVEWLGTSPSQLGVVMVDEAHERTLHTDILFGLIKDVARFRPELKVLVASATMDTARFSTFFDGAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEQQPRWLLYHELVLTTKEFMRQVLEIESSWLLEVAPHYYKAKELEDPHAKKMPKKIGKTREELG

SEQ ID NO: 23131 - protein, 1041 aa, Homo sapiens [sequence omitted]

SEQ ID NO: 23132 - protein, 1041 aa, Homo sapiens; identical to SEQ ID NO: 23129
  Payload ID: 4618
  Gene Symbol: DHX16
  Gene Name: DEAH (Asp-Glu-Ala-His) box polypeptide 16
  Uniprot ID: O60231
  ENSP ID: ENSP00000389862

SEQ ID NO: 23133 - protein, 295 aa, Homo sapiens
  Payload ID: 4618
  Gene Symbol: DHX16
  Gene Name: DEAH (Asp-Glu-Ala-His) box polypeptide 16
  ENSP ID: ENSP00000390319
MSEDPRGPKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQL

SEQ ID NO: 23134 - protein, 1041 aa, Homo sapiens; identical to SEQ ID NO: 23129
  Payload ID: 4618
  Gene Symbol: DHX16
  Gene Name: DEAH (Asp-Glu-Ala-His) box polypeptide 16
  Uniprot ID: O60231
  ENSP ID: ENSP00000390938

SEQ ID NO: 23135 - protein, 669 aa, Homo sapiens
  Payload ID: 4618
  Gene Symbol: DHX16
  Gene Name: DEAH (Asp-Glu-Ala-His) box polypeptide 16
  ENSP ID: ENSP00000391789
MATPAGLERWVQDELHSVLGLSERHVAQFLIGTAQRCTSAEEFVQRLRDTDTLDLSGPARDFALRLWNKVPRKAVVEKPARAAEREARALLEKNRSYRLLEDSEESSEETVSRAGSSLQKKRKKRKHLRKKREEEEEEEASEKGKKKTGGSKQQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERQELKYKRRVRDLAREYRAAGEQEKLEATNRYHMPKETRGQPARAVDLVEEESGAPGEEQRRWEEARLGAASLKFGARDAASQEPKYQLVLEEEETIEFVRATQLQGDEEPSAPPTSTQAQQKESIQAVRRSLPVFPFREELLAAIANHQVLIIEGETGSGKTTQIPQYLFEEGYTNKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARK

SEQ ID NO: 23136 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000393356

SEQ ID NO: 23137 - protein, 1041 aa, Homo sapiens; identical to SEQ ID NO: 23129
  Payload ID: 4618
  Gene Symbol: DHX16
  Gene Name: DEAH (Asp-Glu-Ala-His) box polypeptide 16
  Uniprot ID: O60231
  ENSP ID: ENSP00000393958

SEQ ID NO: 23138 - protein, 1041 aa, Homo sapiens; identical to SEQ ID NO: 23129
  Payload ID: 4618
  Gene Symbol: DHX16
  Gene Name: DEAH (Asp-Glu-Ala-His) box polypeptide 16
  Uniprot ID: O60231
  ENSP ID: ENSP00000396193

SEQ ID NO: 23139 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000399101

SEQ ID NO: 23140 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000403116

SEQ ID NO: 23141 - protein, 560 aa, Homo sapiens; identical to SEQ ID NO: 23128
  Payload ID: 4618
  Gene Symbol: DHX16
  Gene Name: DEAH (Asp-Glu-Ala-His) box polypeptide 16
  ENSP ID: ENSP00000405391

SEQ ID NO: 23142 - protein, 560 aa, Homo sapiens; identical to SEQ ID NO: 23128
  Payload ID: 4618
  Gene Symbol: DHX16
  Gene Name: DEAH (Asp-Glu-Ala-His) box polypeptide 16
  ENSP ID: ENSP00000406462

SEQ ID NO: 23143 - protein, 1041 aa, Homo sapiens; identical to SEQ ID NO: 23129
  Payload ID: 4618
  Gene Symbol: DHX16
  Gene Name: DEAH (Asp-Glu-Ala-His) box polypeptide 16
  Uniprot ID: O60231
  ENSP ID: ENSP00000408956

SEQ ID NO: 23144 - protein, 560 aa, Homo sapiens; identical to SEQ ID NO: 23128
  Payload ID: 4618
  Gene Symbol: DHX16
  Gene Name: DEAH (Asp-Glu-Ala-His) box polypeptide 16
  ENSP ID: ENSP00000409038

SEQ ID NO: 23145 - protein, 560 aa, Homo sapiens; identical to SEQ ID NO: 23128
  Payload ID: 4618
  Gene Symbol: DHX16
  Gene Name: DEAH (Asp-Glu-Ala-His) box polypeptide 16
  ENSP ID: ENSP00000409091

SEQ ID NO: 23146 - protein, 560 aa, Homo sapiens; identical to SEQ ID NO: 23128
  Payload ID: 4618
  Gene Symbol: DHX16
  Gene Name: DEAH (Asp-Glu-Ala-His) box polypeptide 16
  ENSP ID: ENSP00000409558

SEQ ID NO: 23147 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000409812

SEQ ID NO: 23148 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000411743

SEQ ID NO: 23149 - protein, 188 aa, Homo sapiens
  Payload ID: 4618
  Gene Symbol: DHX16
  Gene Name: DEAH (Asp-Glu-Ala-His) box polypeptide 16
  ENSP ID: ENSP00000412716
MESQPAQECLMQMFLPIEPACFVEWLGTSPSQLGVVMVDEAHERTLHTDILFGLIKDVARFRPELKVLVASATMDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARK

SEQ ID NO: 23150 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000413416

SEQ ID NO: 23151 - protein, 295 aa, Homo sapiens; identical to SEQ ID NO: 23133
  Payload ID: 4618
  Gene Symbol: DHX16
  Gene Name: DEAH (Asp-Glu-Ala-His) box polypeptide 16
  ENSP ID: ENSP00000414335

SEQ ID NO: 23152 - protein, 1369 aa, Homo sapiens
  Payload ID: 4619
  Gene Symbol: DHX29
  Gene Name: DEAH (Asp-Glu-Ala-His) box polypeptide 29
  Uniprot ID: Q7Z478
  ENSP ID: ENSP00000251636
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 23153 - protein, 160 aa, Homo sapiens
  Payload ID: 4619
  Gene Symbol: DHX29
  Gene Name: DEAH (Asp-Glu-Ala-His) box polypeptide 29
  ENSP ID: ENSP00000421435
  MOD_RES (1)..(1): Any amino acid
XRPRWSGPPCLLPEPNLPRLELPGRPKARSQCPGRPPLPLPLPAPGSPVSSKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQI

SEQ ID NO: 23154 - protein, 1370 aa, Homo sapiens
  Payload ID: 4619
  Gene Symbol: DHX29
  Gene Name: DEAH (Asp-Glu-Ala-His) box polypeptide 29
  ENSP ID: ENSP00000481966
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKGKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENNN

SEQ ID NO: 23155 - protein, 743 aa, Homo sapiens
  Payload ID: 4620
  Gene Symbol: DHX32
  Gene Name: DEAH (Asp-Glu-Ala-His) box polypeptide 32
  Uniprot ID: Q7L7V1
  ENSP ID: ENSP00000284690
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELKLIINSSPHLISKLNSYYGNVPVIEVKNKHPVEVVYLSEAQKDSFESILRLIFEIHHSGEKGDIVVFLACEQDIEKVCETVYQGSNLNPDLGELVVVPLYPKEKCSLFKPLDETEKRCQVYQRRVVLTTSSGEFLIWSNSVRFVIDVGVERRKVYNPRIRANSLVMQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 23156 - protein, 367 aa, Homo sapiens
  Payload ID: 4620
  Gene Symbol: DHX32
  Gene Name: DEAH (Asp-Glu-Ala-His) box polypeptide 32
  ENSP ID: ENSP00000357710
MQPISQSQAEIRKQILGSSSSGKFFCLYTEEFASKDMTPLKPAEMQEANLTSMVLFMKRIDIAGLGHCDFMNRPAPESLMQALEDLDYLAALDNDGNLSEFGIIMSEFPLDPQLSKSILASCEFDCVDEVLTIAAMVTAPNCFSHVPHGAEEAALTCWKTFLHPEGDHFTLISIYKAYQDTTLNSSSEYCVEKWCRDYFLNCSALRMADVIRAELLEIIKRIELPYAEPAFGSKENTLNIKKALLSGYFMQIARDVDGSGNYLMLTHKQVAQLHPLSGYSITKKMPEWVLFHKFSISENNYIRITSEISPELFMQLVPQYYFSNLPPSESKDILQQVVDHLSPVSTMNKEQQMCETCPETEQRCTLQ

SEQ ID NO: 23157 - protein, 112 aa, Homo sapiens
  Payload ID: 4620
  Gene Symbol: DHX32
  Gene Name: DEAH (Asp-Glu-Ala-His) box polypeptide 32
  ENSP ID: ENSP00000406781
MEEEGLECPNSSSEKRYFPESLDSSDGDEEEVLACEDLELNPFDGLPYSSRYYKLLKEREDLPIWKEKYSFMENLLQNQIVIVSGDAKCGKSAQVPQWCAEYCLSIHYQHGG

SEQ ID NO: 23158 - protein, 707 aa, Homo sapiens
  Payload ID: 4621
  Gene Symbol: DHX33
  Gene Name: DEAH (Asp-Glu-Ala-His) box polypeptide 33
  Uniprot ID: Q9H6R0
  ENSP ID: ENSP00000225296
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 23159 - protein, 483 aa, Homo sapiens
  Payload ID: 4621
  Gene Symbol: DHX33
  Gene Name: DEAH (Asp-Glu-Ala-His) box polypeptide 33
  ENSP ID: ENSP00000413779
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGSPFFTGHPGVPHWAGGDRSHEQDVPRHCKAPPRRLPCDAGPSSVRLPALCTAAPSLPRGPKDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 23160 - protein, 93 aa, Homo sapiens
  Payload ID: 4621
  Gene Symbol: DHX33
  Gene Name: DEAH (Asp-Glu-Ala-His) box polypeptide 33
  ENSP ID: ENSP00000458203
KRFRPGSGPPSRAGSFPPGRQVVMLLTAGSGGRGGGGGRRQQPPLAQPSASPYPEAVELQRRSLPIFQARGQLLAQLRNLDNAVLIGWLYSAL

SEQ ID NO: 23161 - protein, 617 aa, Homo sapiens
  Payload ID: 4621
  Gene Symbol: DHX33
  Gene Name: DEAH (Asp-Glu-Ala-His) box polypeptide 33
  ENSP ID: ENSP00000458925
  MOD_RES (1)..(1): Any amino acid
XRAAAAEEEEEAGGSSRPWPSPRPVPTLKLWSCSAGVCPSSKRGGNCWPSSETWTTRSSSVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQHPIQVFYTKQPQNDYLHAALVSVFQIHQEAPSSQDILVFLTGQEEIEAMSKTCRDIAKHLPDGCPAMLVLPLYASLPYAQQLRVFQGAPKGYRKVIISTNIAETSITITGIKYVVDTGMVKAKKYNPDSGLEVLAVQRVSKTQAWQRTGRAGREDSGICYRLYTEDEFEKFDKMTVPEIQRCNLASVMLQLLAMKVPNVLTFDFMSKPSPDHIQAAIAQLDLLGALEHKDDQLTLTPMGRKMAAFPLEPKFAKTILMSPKFHCTEEILTIVSLLSVDSVLHNPPSRREEVQGVRKKFISSEGDHMTLLNIYRTFKNLGGNKDWCKENFVNSKNMTLVAEVRAQLRDICLKMSMPIASSRGDVESVRRCLAHSLFMSTAELQPDGTYATTDTHQPVAIHPSSVLFHCKPACVVYTELLYTNKCYMRDLCVIDAQWLYEAAPEYFRRKLRTARN

SEQ ID NO: 23162 - protein, 1143 aa, Homo sapiens
  Payload ID: 4622
  Gene Symbol: DHX34
  Gene Name: DEAH (Asp-Glu-Ala-His) box polypeptide 34
  Uniprot ID: Q14147
  ENSP ID: ENSP00000331907
MPPPRTREGRDRRDHHRAPSEEEALEKWDWNCPETRRLLEDAFFREEDYIRQGSEECQKFWTFFERLQRFQNLKTSRKEEKDPGQPKHSIPALADLPRTYDPRYRINLSVLGPATRGSQGLGRHLPAERVAEFRRALLHYLDFGQKQAFGRLAKLQRERAALPIAQYGNRILQTLKEHQVVVVAGDTGCGKSTQVPQYLLAAGFSHVACTQPRRIACISLAKRVGFESLSQYGSQVGYQIRFESTRSAATKIVFLTVGLLLRQIQREPSLPQYEVLIVDEVHERHLHNDFLLGVLQRLLPTRPDLKVILMSATINISLFSSYFSNAPVVQVPGRLFPITVVYQPQEAEPTTSKSEKLDPRPFLRVLESIDHKYPPEERGDLLVFLSGMAEISAVLEAAQTYASHTQRWVVLPLHSALSVADQDKVFDVAPPGVRKCILSTNIAETSVTIDGIRFVVDSGKVKEMSYDPQAKLQRLQEFWISQASAEQRKGRAGRTGPGVCFRLYAESDYDAFAPYPVPEIRRVALDSLVLQMKSMSVGDPRTFPFIEPPPPASLETAILYLRDQGALDSSEALTPIGSLLAQLPVDVVIGKMLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 23163 - protein, 272 aa, Homo sapiens
  Payload ID: 4622
  Gene Symbol: DHX34
  Gene Name: DEAH (Asp-Glu-Ala-His) box polypeptide 34
  ENSP ID: ENSP00000418656
  MOD_RES (1)..(1): Any amino acid
XSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGRRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRGMAACWESHSDLADLLV

SEQ ID NO: 23164 - protein, 703 aa, Homo sapiens
  Payload ID: 4623
  Gene Symbol: DHX35
  Gene Name: DEAH (Asp-Glu-Ala-His) box polypeptide 35
  Uniprot ID: Q9H5Z1
  ENSP ID: ENSP00000252011
MAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 23165 - protein, 672 aa, Homo sapiens
  Payload ID: 4623
  Gene Symbol: DHX35
  Gene Name: DEAH (Asp-Glu-Ala-His) box polypeptide 35
  Uniprot ID: Q9H5Z1
  ENSP ID: ENSP00000362420
MAAPVGPVKFWRPGTEGPGVSISEERQSLAENSGTTVVYNPYAALSIEQQRQKLPVFKYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 23166 - protein, 679 aa, Homo sapiens
  Payload ID: 4623
  Gene Symbol: DHX35
  Gene Name: DEAH (Asp-Glu-Ala-His) box polypeptide 35
  ENSP ID: ENSP00000362422
MAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEEVETVVSMLIEQARALARTGMKRHLRVLPMYAGLPSFEQMKVFERVSRSVRKVIVATNVAETSITISGIVYVIDCGFVKLRAYNPRTAIECLVVVPVSQASANQRAGRGGRSRSGKCYRLYTEEAFDKLPQSTVPEMQRSNLAPVILQLKALGIDNVLRFHFMSPPPAQSMVQALELLYALGGLDKDCRLTEPLGMRIAEFPLNPMFAKMLLESGNFGCSQEILSIAAMMQIQNIFVVPPNQKSHAIRVHRKFAVEEGDHLTMLNIYEAFIKHNKDSKWCQEHFLNYKGLVRAATVREQLKKLLVKFQVPRKSSEGDPDLVLRCIVSGFFANAARFHSTGAYRVIYNEVIQTSKYYMRDVTAIESAWLLELAPHFYQQGTHLSLKAKRAKVQDP

SEQ ID NO: 23167 - protein, 167 aa, Homo sapiens
  Payload ID: 4623
  Gene Symbol: DHX35
  Gene Name: DEAH (Asp-Glu-Ala-His) box polypeptide 35
  ENSP ID: ENSP00000397997
IAAMMQIQNIFVVPPNQKSHAHNKDSKWCQEHFLNYKGLVRAATVREQLKKLLVKFQVPRKSSEGDPDLVLRCIVSGFFANAARFHSTGAYRTIRDDHELHIHPASVLYAEKPPRWVIYNEVIQTSKYYMRDVTAIESAWLLELAPHFYQQGTHLSLKAKRAKVQDP

SEQ ID NO: 23168 - protein, 126 aa, Homo sapiens
  Payload ID: 4623
  Gene Symbol: DHX35
  Gene Name: DEAH (Asp-Glu-Ala-His) box polypeptide 35
  ENSP ID: ENSP00000432603
MAAPVGPVKFWRPGTEGPGVSISEERQSLAENSGTTVVYNPYAALSIEQQRQKLPVFKLRNHILYLIENYQTVVIVGETGCGKSTQIPQYLAEAGWTAEGRVVGVTQPRRVAAVTHDLSSQRLQGE

SEQ ID NO: 23169 - protein, 979 aa, Homo sapiens
  Payload ID: 4624
  Gene Symbol: DHX36
  Gene Name: DEAH (Asp-Glu-Ala-His) box polypeptide 36
  Uniprot ID: Q9H2U1
  ENSP ID: ENSP00000309296
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 23170 - protein, 994 aa, Homo sapiens
  Payload ID: 4624
  Gene Symbol: DHX36
  Gene Name: DEAH (Asp-Glu-Ala-His) box polypeptide 36
  Uniprot ID: Q9H2U1
  ENSP ID: ENSP00000330113
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 23171 - protein, 1008 aa, Homo sapiens
  Payload ID: 4624
  Gene Symbol: DHX36
  Gene Name: DEAH (Asp-Glu-Ala-His) box polypeptide 36
  Uniprot ID: Q9H2U1
  ENSP ID: ENSP00000417078
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 23172 - protein, 119 aa, Homo sapiens
  Payload ID: 4624
  Gene Symbol: DHX36
  Gene Name: DEAH (Asp-Glu-Ala-His) box polypeptide 36
  ENSP ID: ENSP00000418756
NALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQIMRR

SEQ ID NO: 23173 - protein, 187 aa, Homo sapiens
  Payload ID: 4624
  Gene Symbol: DHX36
  Gene Name: DEAH (Asp-Glu-Ala-His) box polypeptide 36
  ENSP ID: ENSP00000419761
  MOD_RES (1)..(1): Any amino acid
XIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKNALDKQEELTPLGVHLARLPVEPHIGKMILFGALFCCLDPVLTIAASLSFKDPFVIPLGKEKI

SEQ ID NO: 23174 - protein, 797 aa, Homo sapiens
  Payload ID: 4624
  Gene Symbol: DHX36
  Gene Name: DEAH (Asp-Glu-Ala-His) box polypeptide 36
  ENSP ID: ENSP00000419862
MDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHY

SEQ ID NO: 23175 - protein, 4 aa, Homo sapiens
  Payload ID: 4624
  Gene Symbol: DHX36
  Gene Name: DEAH (Asp-Glu-Ala-His) box polypeptide 36
  ENSP ID: ENSP00000485828
IMRR

SEQ ID NO: 23176 - protein, 216 aa, Homo sapiens
  Payload ID: 4624
  Gene Symbol: DHX36
  Gene Name: DEAH (Asp-Glu-Ala-His) box polypeptide 36
  ENSP ID: ENSP00000486184
MLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 23177 - protein, 216 aa, Homo sapiens; identical to SEQ ID NO: 23176
  Payload ID: 4624
  Gene Symbol: DHX36
  Gene Name: DEAH (Asp-Glu-Ala-His) box polypeptide 36
  ENSP ID: ENSP00000486321

SEQ ID NO: 23178 - protein, 216 aa, Homo sapiens; identical to SEQ ID NO: 23176
  Payload ID: 4624
  Gene Symbol: DHX36
  Gene Name: DEAH (Asp-Glu-Ala-His) box polypeptide 36
  ENSP ID: ENSP00000486604

SEQ ID NO: 23179 - protein, 91 aa, Homo sapiens
  Payload ID: 4624
  Gene Symbol: DHX36
  Gene Name: DEAH (Asp-Glu-Ala-His) box polypeptide 36
  ENSP ID: ENSP00000486956
MLHNMKGQFAEHLLGAGFVSSRNPKDPESNINSDNEKIIKAVICAGLYPKVAKIRLNLGKKRKMVKVYTKTDGLVAVHPKSVNVEQTDFHY

SEQ ID NO: 23180 - protein, 1157 aa, Homo sapiens
  Payload ID: 4625
  Gene Symbol: DHX37
  Gene Name: DEAH (Asp-Glu-Ala-His) box polypeptide 37
  Uniprot ID: Q8IY37
  ENSP ID: ENSP00000311135
MGKLRRRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKYLLAEYCEWLPQAMHPDIEKAWPPTTVH

SEQ ID NO: 23181 - protein, 962 aa, Homo sapiens
  Payload ID: 4625
  Gene Symbol: DHX37
  Gene Name: DEAH (Asp-Glu-Ala-His) box polypeptide 37
  ENSP ID: ENSP00000439009
MTVPPPPAAAPPLPRALAKPAVFIPVNRSPEMQEERLKLPILSEEQVIMEAVAEHPIVIVCGETGSGKTTQVPQFLYEAGFSSEDSIIGVTEPRRVAAVAMSQRVAKEMNLSQRVVSYQIRYEGNVTEETRIKFMTDGVLLKEIQKDFLLLRYKVVIIDEAHERSVYTDILIGLLSRIVTLRAKRNLPLKLLIMSATLRVEDFTQNPRLFAKPPPVIKVESRQFPVTVHFNKRTPLEDYSGECFRKVCKIHRMLPAGGILVFLTGQAEVHALCRRLRKAFPPSRARPQEKDDDQKDSVEEMRKFKKSRARAKKARAEVLPQINLDHYSVLPAGEGDEDREAEVDEEEGALDSDLDLDLGDGGQDGGEQPDASLPLHVLPLYSLLAPEKQAQVFKPPPEGTRLCVVATNVAETSLTIPGIKYVVDCGKVKKRYYDRVTGVSSFRVTWVSQASADQRAGRAGRTEPGHCYRLYSSAVFGDFEQFPPPEITRRPVEDLILQMKALNVEKVINFPFPTPPSVEALLAAEELLIALGALQPPQKAERVKQLQENRLSCPITALGRTMATFPVAPRYAKMLALSRQHGCLPYAITIVASMTVRELFEELDRPAASDEELTRLKSKRARVAQMKRTWAGQGASLKLGDLMVLLGAVGACEYASCTPQFCEANGLRYKAMMEIRRLRGQLTTAVNAVCPEAELFVDPKMQPPTESQVTYLRQIVTAGLGDHLARRVQSEEMLEDKWRNAYKTPLLDDPVFIHPSSVLFKELPEFVVYQEIVETTKMYMKGVSSVEVQWIPALLPSYCQFDKPLEEPAPTYCPERGRVLCHRASVFYRVGWPLPAIEVDFPEGIDRYKHFARFLLEGQVFRKLASYRSCLLSSPGTMLKTWARLQPRTESLLRALVAEKADCHEALLAAWKKNPKCEFDQGQGVGVDRMGSLRQGLCALCTVSPGLAEGSGPTAAGQLFAT

SEQ ID NO: 23182 - protein, 133 aa, Homo sapiens
  Payload ID: 4625
  Gene Symbol: DHX37
  Gene Name: DEAH (Asp-Glu-Ala-His) box polypeptide 37
  ENSP ID: ENSP00000443661
MRTGRQKWMRKRGPWTPTSIWTWGMAGKMEVSSRMPPSRSTCSRCTLCWPQRSKHRSLSLHRRGLGCVLWPPMWPRRRLPSLASSTWWTVGRSRNATTTASLAYPPSVSPGSPRHQLTSERAEQDGRSPATAT

SEQ ID NO: 23183 - protein, 1227 aa, Homo sapiens
  Payload ID: 4626
  Gene Symbol: DHX38
  Gene Name: DEAH (Asp-Glu-Ala-His) box polypeptide 38
  Uniprot ID: Q92620
  ENSP ID: ENSP00000268482
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 23184 - protein, 191 aa, Homo sapiens
  Payload ID: 4626
  Gene Symbol: DHX38
  Gene Name: DEAH (Asp-Glu-Ala-His) box polypeptide 38
  ENSP ID: ENSP00000454521
  MOD_RES (1)..(1): Any amino acid
XMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 23185 - protein, 138 aa, Homo sapiens
  Payload ID: 4626
  Gene Symbol: DHX38
  Gene Name: DEAH (Asp-Glu-Ala-His) box polypeptide 38
  ENSP ID: ENSP00000455939
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERE

SEQ ID NO: 23186 - protein, 123 aa, Homo sapiens
  Payload ID: 4626
  Gene Symbol: DHX38
  Gene Name: DEAH (Asp-Glu-Ala-His) box polypeptide 38
  ENSP ID: ENSP00000457887
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGG

SEQ ID NO: 23187 - protein, 142 aa, Homo sapiens
  Payload ID: 4626
  Gene Symbol: DHX38
  Gene Name: DEAH (Asp-Glu-Ala-His) box polypeptide 38
  ENSP ID: ENSP00000462149
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRLQMAFGSASLPPILPRRLSLLTASCLLSILVIAN

SEQ ID NO: 23188 - protein, 187 aa, Homo sapiens
  Payload ID: 4626
  Gene Symbol: DHX38
  Gene Name: DEAH (Asp-Glu-Ala-His) box polypeptide 38
  ENSP ID: ENSP00000462397
LNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQEQEKRSPLGSVRSTKIYTPGRKEQGEPMTPRRTPARFGL

SEQ ID NO: 23189 - protein, 128 aa, Homo sapiens
  Payload ID: 4626
  Gene Symbol: DHX38
  Gene Name: DEAH (Asp-Glu-Ala-His) box polypeptide 38
  ENSP ID: ENSP00000462965
VVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPGQREVAGPIASKTGPGHLVYA

SEQ ID NO: 23190 - protein, 779 aa, Homo sapiens
  Payload ID: 4627
  Gene Symbol: DHX40
  Gene Name: DEAH (Asp-Glu-Ala-His) box polypeptide 40
  Uniprot ID: Q8IX18
  ENSP ID: ENSP00000251241
MSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 23191 - protein, 702 aa, Homo sapiens
  Payload ID: 4627
  Gene Symbol: DHX40
  Gene Name: DEAH (Asp-Glu-Ala-His) box polypeptide 40
  Uniprot ID: Q8IX18
  ENSP ID: ENSP00000388749
MSRFPAVAGRAPRRQEEGERSRDLQEERLSAVCIADREEKGCTSQEGGTTPTFPIQKQRKKIIQAETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 23192 - protein, 250 aa, Homo sapiens
  Payload ID: 4627
  Gene Symbol: DHX40
  Gene Name: DEAH (Asp-Glu-Ala-His) box polypeptide 40
  ENSP ID: ENSP00000437958
  MOD_RES (1)..(1): Any amino acid
XQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLK

SEQ ID NO: 23193 - protein, 71 aa, Homo sapiens
  Payload ID: 4627
  Gene Symbol: DHX40
  Gene Name: DEAH (Asp-Glu-Ala-His) box polypeptide 40
  ENSP ID: ENSP00000462246
MSRFPAVAGRAPRRQEEGERSRDLQEERLSAVCIADREEKGCTSQEGGTTPTFPIQKQRKKIIQAGFHNMV

SEQ ID NO: 23194 - protein, 268 aa, Homo sapiens
  Payload ID: 4627
  Gene Symbol: DHX40
  Gene Name: DEAH (Asp-Glu-Ala-His) box polypeptide 40
  ENSP ID: ENSP00000462686
MSRFPAVAGRAPRRQEEEEKGCTSQEGGTTPTFPIQKQRKKIIQAVRDNSFLIVTGNTGSGKTTQLPKYLYEAGFSQHGMIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFDIPGRLYPVREKFCNLIGPRDRENTAYIQAIVKVTMDIHLNEMAGDILVFLTGQFEIEKS

SEQ ID NO: 23195 - protein, 101 aa, Homo sapiens
  Payload ID: 4627
  Gene Symbol: DHX40
  Gene Name: DEAH (Asp-Glu-Ala-His) box polypeptide 40
  ENSP ID: ENSP00000462702
MSRFPAVAGRAPRRQEEGERSRDLQEERLSAVCIADREEKGCTSQEGGTTPTFPIQKQRKKIIQAVRDNSFLIVTGNTGSGKTTQLPKYLYEAGDSNQIYD

SEQ ID NO: 23196 - protein, 173 aa, Homo sapiens
  Payload ID: 4627
  Gene Symbol: DHX40
  Gene Name: DEAH (Asp-Glu-Ala-His) box polypeptide 40
  ENSP ID: ENSP00000463025
MSRFPAVAGRAPRRQEEGERSRDLQEERLSAVCIADRGFSQHGMIGVTQPRKVAAISVAQRVAEEMKCTLGSKVGYQVRFDDCSSKETAIKYMTDGCLLKHILGDPNLTKFSVIILDEAHERTLTTDILFGLLKKLFQEKSPNRKEHLKVVVMSATMELAKLSAFFGNCPIFD

SEQ ID NO: 23197 - protein, 1220 aa, Homo sapiens [sequence omitted]

SEQ ID NO: 23198 - protein, 1181 aa, Homo sapiens
  Payload ID: 4628
  Gene Symbol: DHX8
  Gene Name: DEAH (Asp-Glu-Ala-His) box polypeptide 8
  ENSP ID: ENSP00000437886
MAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPECPKHFLPVVAVAVSLEQCLSKFEDLNKELGLVTC

SEQ ID NO: 23199 - protein, 33 aa, Homo sapiens
  Payload ID: 4628
  Gene Symbol: DHX8
  Gene Name: DEAH (Asp-Glu-Ala-His) box polypeptide 8
  ENSP ID: ENSP00000465178
  MOD_RES (1)..(1): Any amino acid
XYRTLIDQQVVYIHPSSALFNRQPEWTVPMGHV

SEQ ID NO: 23200 - protein, 138 aa, Homo sapiens
  Payload ID: 4628
  Gene Symbol: DHX8
  Gene Name: DEAH (Asp-Glu-Ala-His) box polypeptide 8
  ENSP ID: ENSP00000466900
KAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWDLYSRFSEWKSGTNCSSLSGT

SEQ ID NO: 23201 - protein, 53 aa, Homo sapiens
  Payload ID: 4628
  Gene Symbol: DHX8
  Gene Name: DEAH (Asp-Glu-Ala-His) box polypeptide 8
  ENSP ID: ENSP00000467834
MAVAVAMAGALIGSEPGPAEELAKLEYLSLVSKVCTELDNHLGINDKDLGFSY

SEQ ID NO: 23202 - protein, 717 aa, Homo sapiens
  Payload ID: 4629
  Gene Symbol: DQX1
  Gene Name: DEAQ box RNA-dependent ATPase 1
  Uniprot ID: Q8TE96
  ENSP ID: ENSP00000377523
MTSQPLRLAEEYGPSPGESELAVNPFDGLPFSSRYYELLKQRQALPIWAARFTFLEQLESNPTGVVLVSGEPGSGKSTQIPQWCAEFALARGFQKGQVTVTQPYPLAARSLALRVADEMDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPGSCLCLYPKSFLELEAPPLPQPRVCEENLSSLVLLLKRRQIAEPGECHFLDQPAPEALMQALEDLDYLAALDDDGDLSDLGVILSEFPLAPELAKALLASCEFDCVDEMLTLAAMLTAAPGFTRPPLSAEEAALRRALEHTDGDHSSLIQVYEAFIQSGADEAWCQARGLNWAALCQAHKLRGELLELMQRIELPLSLPAFGSEQNRRDLQKALVSGYFLKVARDTDGTGNYLLLTHKHVAQLSSYCCYRSRRAPARPPPWVLYHNFTISKDNCLSIVSEIQPQMLVELAPPYFLSNLPPSESRDLLNQLREGMADSTAGSKSSSAQEFRDPCVLQ

SEQ ID NO: 23203 - protein, 717 aa, Homo sapiens; identical to SEQ ID NO: 23202
  Payload ID: 4629
  Gene Symbol: DQX1
  Gene Name: DEAQ box RNA-dependent ATPase 1
  Uniprot ID: Q8TE96
  ENSP ID: ENSP00000384621

SEQ ID NO: 23204 - protein, 132 aa, Homo sapiens
  Payload ID: 4629
  Gene Symbol: DQX1
  Gene Name: DEAQ box RNA-dependent ATPase 1
  ENSP ID: ENSP00000389196
EEISLCCESLSREVESLLLQGLPPRVLPLHPDCGRAVQAVYEDMDARKVVVTHWLADFSFSLPSIQHVIDSGLELRSVYNPRIRAEFQVLRPISKCQAEARRLRARGFPPVVFFPRSFSPQDPASACILSPS

SEQ ID NO: 23205 - protein, 119 aa, Homo sapiens
  Payload ID: 4629
  Gene Symbol: DQX1
  Gene Name: DEAQ box RNA-dependent ATPase 1
  ENSP ID: ENSP00000392969
MDLTLGHEVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYW

SEQ ID NO: 23206 - protein, 398 aa, Homo sapiens
  Payload ID: 4630
  Gene Symbol: DAP3
  Gene Name: death associated protein 3
  Uniprot ID: P51398
  ENSP ID: ENSP00000341692
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 23207 - protein, 398 aa, Homo sapiens; identical to SEQ ID NO: 23206
  Payload ID: 4630
  Gene Symbol: DAP3
  Gene Name: death associated protein 3
  Uniprot ID: P51398
  ENSP ID: ENSP00000357320

SEQ ID NO: 23208 - protein, 364 aa, Homo sapiens
  Payload ID: 4630
  Gene Symbol: DAP3
  Gene Name: death associated protein 3
  Uniprot ID: P51398
  ENSP ID: ENSP00000412605
MMLKGITRLISRIHKLDPGRFLHMGTQARQSIAAHLDNQVPVESPRAISRTNENDPVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 23209 - protein, 357 aa, Homo sapiens
  Payload ID: 4630
  Gene Symbol: DAP3
  Gene Name: death associated protein 3
  Uniprot ID: P51398
  ENSP ID: ENSP00000445003
MMLKGITRLISRIHKAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKEGFDALDPFIPILVSNYNPKEFESCIQYYLENNWLQHEKAPTEEGKKELLFLSNANPSLLERHCAYL

SEQ ID NO: 23210 - protein, 181 aa, Homo sapiens
  Payload ID: 4630
  Gene Symbol: DAP3
  Gene Name: death associated protein 3
  ENSP ID: ENSP00000476291
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMDWLILHIPDAHLWVKNCRDLLQSSYNKQRFDQPLEASTWLKNFKTTNERFLNQGITRVRNATDAVGIVLKELKRQSSLGMF

SEQ ID NO: 23211 - protein, 210 aa, Homo sapiens
  Payload ID: 4630
  Gene Symbol: DAP3
  Gene Name: death associated protein 3
  ENSP ID: ENSP00000476558
  MOD_RES (1)..(1): Any amino acid
XGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKGFTTWPRLVWNSWAQAICPSQPPKVLGLQEGFDALDPFIPILVSNYNPKEFESCIQYYLENNWLQHEKAPTEEGKKELLFLSNANPSLLERHCAYL

SEQ ID NO: 23212 - protein, 357 aa, Homo sapiens; identical to SEQ ID NO: 23209
  Payload ID: 4630
  Gene Symbol: DAP3
  Gene Name: death associated protein 3
  Uniprot ID: P51398
  ENSP ID: ENSP00000476592

SEQ ID NO: 23213 - protein, 115 aa, Homo sapiens
  Payload ID: 4630
  Gene Symbol: DAP3
  Gene Name: death associated protein 3
  ENSP ID: ENSP00000476624
GITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGKLLQKKGKKSCCS

SEQ ID NO: 23214 - protein, 45 aa, Homo sapiens
  Payload ID: 4630
  Gene Symbol: DAP3
  Gene Name: death associated protein 3
  ENSP ID: ENSP00000476706
ESCIQYYLENNWLQHEKAPTEEGKKELLFLSNANPSLLERHCAYL

SEQ ID NO: 23215 - protein, 119 aa, Homo sapiens
  Payload ID: 4630
  Gene Symbol: DAP3
  Gene Name: death associated protein 3
  ENSP ID: ENSP00000476816
MMLKGITRLISRIHKAKHGDQHEGQHYNISPQDLETVFPHGLPPRFVMQVKTFSEACLMDWLILHIPDAHLWVKNCRDLLQSSYNKQRFDQPLEASTWLKNFKTTNERFLNQIKVQEKY

SEQ ID NO: 23216 - protein, 266 aa, Homo sapiens
  Payload ID: 4630
  Gene Symbol: DAP3
  Gene Name: death associated protein 3
  ENSP ID: ENSP00000476840
MMLKGITRLISRIHKLDPGRFLHMGTQARQSIAAHLDNQVPVESPRAISRTNENDPAKHGDQHEGQHYNISPQDLETVFPHGLPPRFVMQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKNDWHGGAIVSALSQTGSLFKPRKAYL

SEQ ID NO: 23217 - protein, 113 aa, Homo sapiens
  Payload ID: 4630
  Gene Symbol: DAP3
  Gene Name: death associated protein 3
  ENSP ID: ENSP00000476889
MMLKGITRLISRIHKLDPGRFLHMGTQARQSIAAHLDNQVPVESPRAISRTNENDPAKHGDQHEGQHYNISPQDLETVFPHGLPPRFVMQVLKTGNGIGGSPEYKLLLAKGWG

SEQ ID NO: 23218 - protein, 299 aa, Homo sapiens
  Payload ID: 4630
  Gene Symbol: DAP3
  Gene Name: death associated protein 3
  ENSP ID: ENSP00000476899
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQIKVQEKYVWNKRESTEKGSPLGEVVEQGITRVRNATDAVGIVLKELKRQSSLGMFHLLVAVDGINALWGRTTLKREDKSPIAPEELALVHNLRKMMKN

SEQ ID NO: 23219 - protein, 65 aa, Homo sapiens
  Payload ID: 4630
  Gene Symbol: DAP3
  Gene Name: death associated protein 3
  ENSP ID: ENSP00000477025
RLISRIHKAKHGDQHEGQHYNISPQDLETVFPHGLPPRFVMQVLKTGNGIGGSPEYKLLLAKGWG

SEQ ID NO: 23220 - protein, 140 aa, Homo sapiens
  Payload ID: 4630
  Gene Symbol: DAP3
  Gene Name: death associated protein 3
  ENSP ID: ENSP00000477139
GITRVRNATDAVGIVLKELKRQSSLGMFHLLVAVDGINALWGRTTLKREDKSPIAPEELALVHNLRKMMKNDWEGFDALDPFIPILVSNYNPKEFESCIQYYLENNWLQHEKAPTEEGKKELLFLSNANPSLLERHCAYL

SEQ ID NO: 23221 - protein, 242 aa, Homo sapiens
  Payload ID: 4630
  Gene Symbol: DAP3
  Gene Name: death associated protein 3
  ENSP ID: ENSP00000477265
  MOD_RES (1)..(1): Any amino acid
XEGQHYNISPQDLETVFPHGLPPRFVMQVKTFSEACLMVRKPALELLHYLKNTSFAYPAIRYLLYGEKGTGKTLSLCHVIHFCAKQDWLILHIPDAHLWVKNCRDLLQSSYNKQRFDQPLEASTWLKNFKTTNERFLNQGITRVRNATDAVGIVLKELKRQSSLGMFHLLVAVDGINALWGRTTLKREDKSPIAPEELALVHNLRKMMKNDWHGGAIVSALSQTGSLFKPRKAYLPQELLGK

SEQ ID NO: 23222 - protein, 106 aa, Homo sapiens
  Payload ID: 4630
  Gene Symbol: DAP3
  Gene Name: death associated protein 3
  ENSP ID: ENSP00000477453
  MOD_RES (1)..(1): Any amino acid
XLKREDKSPIAPEELALVHNLRKMMKNDWHGGAIVSALSQTGSLFKPRKAYLPQELLGKEFESCIQYYLENNWLQHEKAPTEEGKKELLFLSNANPSLLERHCAYL

SEQ ID NO: 23223 - protein, 107 aa, Homo sapiens
  Payload ID: 4631
  Gene Symbol: DAPL1
  Gene Name: death associated protein-like 1
  Uniprot ID: A0PJW8
  ENSP ID: ENSP00000309538
MANEVQDLLSPRKGGHPPAVKAGGMRISKKQEIGTLERHTKKTGFEKTSAIANVAKIQTLDALNDALEKLNYKFPATVHMAHQKPTPALEKVVPLKRIYIIQQPRKC

SEQ ID NO: 23224 - protein, 174 aa, Homo sapiens
  Payload ID: 4631
  Gene Symbol: DAPL1
  Gene Name: death associated protein-like 1
  ENSP ID: ENSP00000385306
  MOD_RES (1)..(1): Any amino acid
XRISKKQEIGTLERHTKKTGFEKTSAIANVAKIQTLDALNDALEKEQVQLGVRNERQVQPFHHGCSWKETSGFDTSSEDPERLFLSMCLVTVLGNLLIILAVTPDSHLHIPMYFFLSNLSLPDIGFTSTTVPKMIVDIQSHSRVISYAGCLTQMSLFAIFGGMEERHAPECDGL

SEQ ID NO: 23225 - protein, 113 aa, Homo sapiens
  Payload ID: 4631
  Gene Symbol: DAPL1
  Gene Name: death associated protein-like 1
  ENSP ID: ENSP00000386422
MANEVQDLLSPRKGGHPPAVKAGGMRISKKQEIGTLERHTKKTGFEKTSAIANVAKIQTLDALNDALEKEQVQLGVRNERQVQPFHHGCSWKETSGFDTRCPRHTEPRNLTGV

SEQ ID NO: 23226 - protein, 199 aa, Homo sapiens
  Payload ID: 4631
  Gene Symbol: DAPL1
  Gene Name: death associated protein-like 1
  ENSP ID: ENSP00000479225
MANEVQDLLSPRKGGHPPAVKAGGMRISKKQEIGTLERHTKKTGFEKTSAIANVAKIQTLDALNDALEKEQVQLGVRNERQVQPFHHGCSWKETSGFDTRSSEDPERLFLSMCLVTVLGNLLIILAVTPDSHLHIPMYFFLSNLSLPDIGFTSTTVPKMIVDIQSHSRVISYAGCLTQMSLFAIFGGMEERHAPECDGL

SEQ ID NO: 23227 - protein, 134 aa, Homo sapiens
  Payload ID: 4631
  Gene Symbol: DAPL1
  Gene Name: death associated protein-like 1
  ENSP ID: ENSP00000479872
MANEVQDLLSPRKGGHPPAVKAGGMRISKKQEIGTLERHTKKTGFEKTSAIANVAKIQTLDALNDALEKSFALFAQAGKQWSDLSSLQPPPPGFKWFSCLSLPSSWDYSSTINFQQQCTWRIKNPHLLWKRLFH

SEQ ID NO: 23228 - protein, 616 aa, Homo sapiens
  Payload ID: 4632
  Gene Symbol: DTHD1
  Gene Name: death domain containing 1
  Uniprot ID: Q6ZMT9
  ENSP ID: ENSP00000350103
MCLEKRYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 23229 - protein, 781 aa, Homo sapiens
  Payload ID: 4632
  Gene Symbol: DTHD1
  Gene Name: death domain containing 1
  Uniprot ID: Q6ZMT9
  ENSP ID: ENSP00000401597
MHDECTPQQTMSSIQDTKAADIAARGELNVIETATVSPTNGEESHYTNQVQLEKNKTHMSSALVEKENNTSLNGRVLGQEESQNKMFPDNAENEDDKQIEHMTVENINGNREETHGIIQTTETEIQETSESPREEMTTSSIICDISKKYINSTLPNDSENIKHKNNIMEKEYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 23230 - protein, 821 aa, Homo sapiens
  Payload ID: 4632
  Gene Symbol: DTHD1
  Gene Name: death domain containing 1
  ENSP ID: ENSP00000424426
MYVCVEIITFIDCLIKITEHLGSTAALLKKEEKEICNLCGMHDECTPQQTMSSIQDTKAADIAARGELNVIETATVSPTNGEESHYTNQVQLEKNKTHMSSALVEKENNTSLNGRVLGQEESQNKMFPDNAENEDDKQIEHMTVENINGNREETHGIIQTTETEIQETSESPREEMTTSSIICDISKKYINSTLPNDSENIKHKNNIMEKEYLDVLSDVTGPQVSCYITAPSYVLQQLECRIINHMSSLIVGDNEELVSNVITIECSDKEKRVPFPIGIAIPFTARYRGNYRDIMVKVCDINLQSSYLNPNSLEGMKGGYKGTCASVKVYKLGIFSVVSCLKKESFTVTKKGLALKSSMDSRISLNYPPGVFTSPVLVQLKIQPVDPALVAHLKAQQDTFYSVQSTSPLIHIQHPSTYPFQKPVTLFLPCSPYLDKNNLGSEIDHKRRASATINRITPSYFNRTKIASIRKPRKNASECLKLLGFRSQDSGWCGLDDVVKTIQSGLVSVELYEHLERFIVLHLSSTMDNSHLVTFVKSLEEAMLSTTACIVLSHQKDNPHRIAVLVVPSKDLSQVLKDLHLEGFGGPPEPSRHFQVREGEQLLLRFTGNIFASSNGKDYGKDYTLIFHLQRKPRLELQIKEVDEFGNYSCPHYKGTIVVYKVPKGKIVPNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDVAPE

SEQ ID NO: 23231 - protein, 348 aa, Homo sapiens
  Payload ID: 4633
  Gene Symbol: DEDD
  Gene Name: death effector domain containing
  ENSP ID: ENSP00000356984
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCGEEVQGFQRWSRLEGEYKELLGHWAVYAIQYIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 23232 - protein, 318 aa, Homo sapiens
  Payload ID: 4633
  Gene Symbol: DEDD
  Gene Name: death effector domain containing
  Uniprot ID: O75618
  ENSP ID: ENSP00000356985
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGHEAIKLLVNVDEEDYELGRQKLLRNLMLQALP

SEQ ID NO: 23233 - protein, 318 aa, Homo sapiens; identical to SEQ ID NO: 23232
  Payload ID: 4633
  Gene Symbol: DEDD
  Gene Name: death effector domain containing
  Uniprot ID: O75618
  ENSP ID: ENSP00000414821

SEQ ID NO: 23234 - protein, 318 aa, Homo sapiens; identical to SEQ ID NO: 23232
  Payload ID: 4633
  Gene Symbol: DEDD
  Gene Name: death effector domain containing
  Uniprot ID: O75618
  ENSP ID: ENSP00000445835

SEQ ID NO: 23235 - protein, 287 aa, Homo sapiens
  Payload ID: 4633
  Gene Symbol: DEDD
  Gene Name: death effector domain containing
  ENSP ID: ENSP00000476316
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTYLDAFWRDYINGSLLEALKGVFITDSLKQAVGH

SEQ ID NO: 23236 - protein, 318 aa, Homo sapiens; identical to SEQ ID NO: 23232
  Payload ID: 4633
  Gene Symbol: DEDD
  Gene Name: death effector domain containing
  Uniprot ID: O75618
  ENSP ID: ENSP00000476946

SEQ ID NO: 23237 - protein, 321 aa, Homo sapiens
  Payload ID: 4634
  Gene Symbol: DEDD2
  Gene Name: death effector domain containing 2
  Uniprot ID: Q8WXF8
  ENSP ID: ENSP00000336972
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 23238 - protein, 204 aa, Homo sapiens
  Payload ID: 4634
  Gene Symbol: DEDD2
  Gene Name: death effector domain containing 2
  ENSP ID: ENSP00000469233
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDGETGSER

SEQ ID NO: 23239 - protein, 117 aa, Homo sapiens
  Payload ID: 4634
  Gene Symbol: DEDD2
  Gene Name: death effector domain containing 2
  ENSP ID: ENSP00000469898
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSY

SEQ ID NO: 23240 - protein, 326 aa, Homo sapiens
  Payload ID: 4634
  Gene Symbol: DEDD2
  Gene Name: death effector domain containing 2
  Uniprot ID: Q8WXF8
  ENSP ID: ENSP00000470082
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 23241 - protein, 326 aa, Homo sapiens; identical to SEQ ID NO: 23240
  Payload ID: 4634
  Gene Symbol: DEDD2
  Gene Name: death effector domain containing 2
  Uniprot ID: Q8WXF8
  ENSP ID: ENSP00000471512

SEQ ID NO: 23242 - protein, 2240 aa, Homo sapiens
  Payload ID: 4635
  Gene Symbol: DIDO1
  Gene Name: death inducer-obliterator 1
  Uniprot ID: Q9BTC0
  ENSP ID: ENSP00000266070
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGLESPRPNIILGLVICQKIKRPANSGELDKMDEKRTRLQPEEADVPAYPKVATVPQSEKKPSKYPLCSADAAVSTTPPGSPPPPPPLPEPPVLKVLSSLKPAAPSPATAATTAAAASTAASSTASSASKTASPLEHILQTLFGKKKSFDPSAREPPGSTAGLPQEPKTTAEDGVPAPPLLDPIVQQFGQFSKDKALEEEEDDRPYDPEEEYDPERAFDTQLVERGRRHEVERAPEAAAAEREEVAYDPEDETILEEAKVTVDDLPNRMCADVRRNSVERPAEPVAGAATPSLVEQQKMLEELNKQIEEQKRQLEEQEEALRQQRAAVGVSMAHFSVSDALMSPPPKSSLPKAELFQQEQQSADKPASLPPASQASNHRDPRQARRLATETGEGEGEPLSRLSARGAQGALPERDASRGGLVGQAPMPVPEEKEPASSPWASGEKPPAGSEQDGWKAEPGEGTRPATVGDSSARPARRVLLPTPPCGALQPGFPLQHDGERDPFTCPGFASQDKALGSAQYEDPRNLHSAGRSSSPAGETEGDREPQARPGEGTAPLPPPGQKVGGSQPPFQGQREPGPHALGMSGLHGPNFPGPRGPAPPFPEENIASNDGPRGPPPARFGAQKGPIPSLFSGQHGPPPYGDSRGPSPSYLGGPRGVAPSQFEERKDPHGEKREFQDAPYNEVTGAPAQFEGTEQAPFLGSRGGAPFQFGGQRRPLLSQLKGPRGGPPPSQFGGQRGPPPGHFVGPRGPHPSQFETARGPHPNQFEGPRGQAPNFMPGPRGIQPQQFEDQRVHSPPRFTNQRAPAPLQFGGLRGSAPFSEKNEQTPSRFHFQGQAPQVMKPGPRPLLELPSHPPQHRKDRWEEAGPPSALSSSAPGQGPEADGQWASADFREGKGHEYRNQTFEGRQRERFDVGPKEKPLEEPDAQGRASEDRRRERERGRNWSRERDWDRPREWDRHRDKDSSRDWDRNRERSANRDREREADRGKEWDRSRERSRNRERERDRRRDRDRSRSRERDRDKARDRERGRDRKDRSKSKESARDPKPEASRASDAGTASQA

SEQ ID NO: 23243 - protein, 562 aa, Homo sapiens
  Payload ID: 4635
  Gene Symbol: DIDO1
  Gene Name: death inducer-obliterator 1
  Uniprot ID: Q9BTC0
  ENSP ID: ENSP00000346692
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCMYHLGVGLLDPSRSFWIAIPWACPGLGVAALC

SEQ ID NO: 23244 - protein, 544 aa, Homo sapiens
  Payload ID: 4635
  Gene Symbol: DIDO1
  Gene Name: death inducer-obliterator 1
  Uniprot ID: Q9BTC0
  ENSP ID: ENSP00000359391
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCSGKYSYSLHPSLIA

SEQ ID NO: 23245 - protein, 562 aa, Homo sapiens; identical to SEQ ID NO: 23243
  Payload ID: 4635
  Gene Symbol: DIDO1
  Gene Name: death inducer-obliterator 1
  Uniprot ID: Q9BTC0
  ENSP ID: ENSP00000359394

SEQ ID NO: 23246 - protein, 562 aa, Homo sapiens; identical to SEQ ID NO: 23243
  Payload ID: 4635
  Gene Symbol: DIDO1
  Gene Name: death inducer-obliterator 1
  Uniprot ID: Q9BTC0
  ENSP ID: ENSP00000359397

SEQ ID NO: 23247 - protein, 1189 aa, Homo sapiens
  Payload ID: 4635
  Gene Symbol: DIDO1
  Gene Name: death inducer-obliterator 1
  Uniprot ID: Q9BTC0
  ENSP ID: ENSP00000378749
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGKRRLSGWR

SEQ ID NO: 23248 - protein, 2240 aa, Homo sapiens; identical to SEQ ID NO: 23242
  Payload ID: 4635
  Gene Symbol: DIDO1
  Gene Name: death inducer-obliterator 1
  Uniprot ID: Q9BTC0
  ENSP ID: ENSP00000378752

SEQ ID NO: 23249 - protein, 102 aa, Homo sapiens
  Payload ID: 4636
  Gene Symbol: DAP
  Gene Name: death-associated protein
  Uniprot ID: P51397
  ENSP ID: ENSP00000230895
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRK

SEQ ID NO: 23250 - protein, 204 aa, Homo sapiens
  Payload ID: 4636
  Gene Symbol: DAP
  Gene Name: death-associated protein
  ENSP ID: ENSP00000394163
MSSPPEGKLETKAGHPPAVKAGGMRIVQKHPHTGDTKEEKDKDDQEWESPRVTKISPRRLRRWLTRSRMPPWTSILPQEPSTSSSHASEPGVHQPAPWPRLCCTWYFPDRENQQFRPNPTLLGNLRQNQVLCPLPYISIFKTRNSSSPNLVYGESGWMSFEDHCAPRGAISRICQDPRKILALVLFQQSPDVLVYGLKNKKAHI

SEQ ID NO: 23251 - protein, 1430 aa, Homo sapiens
  Payload ID: 4637
  Gene Symbol: DAPK1
  Gene Name: death-associated protein kinase 1
  Uniprot ID: P53355
  ENSP ID: ENSP00000350785
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 23252 - protein, 1430 aa, Homo sapiens; identical to SEQ ID NO: 23251
  Payload ID: 4637
  Gene Symbol: DAPK1
  Gene Name: death-associated protein kinase 1
  Uniprot ID: P53355
  ENSP ID: ENSP00000386135

SEQ ID NO: 23253 - protein, 1430 aa, Homo sapiens; identical to SEQ ID NO: 23251
  Payload ID: 4637
  Gene Symbol: DAPK1
  Gene Name: death-associated protein kinase 1
  Uniprot ID: P53355
  ENSP ID: ENSP00000417076

SEQ ID NO: 23254 - protein, 188 aa, Homo sapiens
  Payload ID: 4637
  Gene Symbol: DAPK1
  Gene Name: death-associated protein kinase 1
  ENSP ID: ENSP00000417746
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVGVSG

SEQ ID NO: 23255 - protein, 1364 aa, Homo sapiens
  Payload ID: 4637
  Gene Symbol: DAPK1
  Gene Name: death-associated protein kinase 1
  Uniprot ID: P53355
  ENSP ID: ENSP00000418885
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 23256 - protein, 1364 aa, Homo sapiens; identical to SEQ ID NO: 23255
  Payload ID: 4637
  Gene Symbol: DAPK1
  Gene Name: death-associated protein kinase 1
  Uniprot ID: P53355
  ENSP ID: ENSP00000419026

SEQ ID NO: 23257 - protein, 1430 aa, Homo sapiens; identical to SEQ ID NO: 23251
  Payload ID: 4637
  Gene Symbol: DAPK1
  Gene Name: death-associated protein kinase 1
  Uniprot ID: P53355
  ENSP ID: ENSP00000484267

SEQ ID NO: 23258 - protein, 370 aa, Homo sapiens
  Payload ID: 4638
  Gene Symbol: DAPK2
  Gene Name: death-associated protein kinase 2
  Uniprot ID: Q9UIK4
  ENSP ID: ENSP00000261891
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 23259 - protein, 370 aa, Homo sapiens; identical to SEQ ID NO: 23258
  Payload ID: 4638
  Gene Symbol: DAPK2
  Gene Name: death-associated protein kinase 2
  Uniprot ID: Q9UIK4
  ENSP ID: ENSP00000408277

SEQ ID NO: 23260 - protein, 80 aa, Homo sapiens
  Payload ID: 4638
  Gene Symbol: DAPK2
  Gene Name: death-associated protein kinase 2
  ENSP ID: ENSP00000452970
MFQASMRSPNMEPFKQQKVEDFYDIGEELGSGQFAIVKKCREKSTGLEYAAKFIKKRQSRASRRGVSREEIEREVSILRQ

SEQ ID NO: 23261 - protein, 48 aa, Homo sapiens
  Payload ID: 4638
  Gene Symbol: DAPK2
  Gene Name: death-associated protein kinase 2
  ENSP ID: ENSP00000453101
MKKVHLRPDEDLTEFHSYCLGWSAMARSRLTATSASWLQAILLRQPPE

SEQ ID NO: 23262 - protein, 488 aa, Homo sapiens
  Payload ID: 4638
  Gene Symbol: DAPK2
  Gene Name: death-associated protein kinase 2
  Uniprot ID: Q9UIK4
  ENSP ID: ENSP00000453235
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITSKGEGRAPEQRKTEPTQLKTKHLREYTLKCHSSMPPNNSYVNFERFACVVEDVARVDLGCRALVEAHDTIQDDVEALVSIFNEKEAWYREENESARHDLSQLRYEFRKVESLKKLLREDIQATGCSLGSMARKLDHLQAQFEILRQELSADLQWIQELVGSFQLESGSSEGLGSTFYQDTSESLSELLSRSCTEEFLAGWKL

SEQ ID NO: 23263 - protein, 88 aa, Homo sapiens
  Payload ID: 4638
  Gene Symbol: DAPK2
  Gene Name: death-associated protein kinase 2
  ENSP ID: ENSP00000453284
MFQASMRSPNMEPFKQQKVEDFYDIGEELGRFLAGILLFQTLHLLLTLLLLPACFSLLSCPSSSQRTAHLALWPVCHREEVPGEEHGA

SEQ ID NO: 23264 - protein, 91 aa, Homo sapiens
  Payload ID: 4638
  Gene Symbol: DAPK2
  Gene Name: death-associated protein kinase 2
  ENSP ID: ENSP00000453639
MFQASMRSPNMEPFKQQKVEDFYDIGEELGSGQFAIVKKCREKSTGLEYAAKFIKKRQSRASRRGVSREEIERESVWRRALRFPGPEGVTE

SEQ ID NO: 23265 - protein, 488 aa, Homo sapiens; identical to SEQ ID NO: 23262
  Payload ID: 4638
  Gene Symbol: DAPK2
  Gene Name: death-associated protein kinase 2
  Uniprot ID: Q9UIK4
  ENSP ID: ENSP00000484390

SEQ ID NO: 23266 - protein, 454 aa, Homo sapiens
  Payload ID: 4639
  Gene Symbol: DAPK3
  Gene Name: death-associated protein kinase 3
  Uniprot ID: O43293
  ENSP ID: ENSP00000301264
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 23267 - protein, 454 aa, Homo sapiens; identical to SEQ ID NO: 23266
  Payload ID: 4639
  Gene Symbol: DAPK3
  Gene Name: death-associated protein kinase 3
  Uniprot ID: O43293
  ENSP ID: ENSP00000442973

SEQ ID NO: 23268 - protein, 141 aa, Homo sapiens
  Payload ID: 4639
  Gene Symbol: DAPK3
  Gene Name: death-associated protein kinase 3
  ENSP ID: ENSP00000470115
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLK

SEQ ID NO: 23269 - protein, 92 aa, Homo sapiens
  Payload ID: 4639
  Gene Symbol: DAPK3
  Gene Name: death-associated protein kinase 3
  ENSP ID: ENSP00000470168
  MOD_RES (1)..(1): Any amino acid
XSGASPFLGETKQETLTNISAVNYDFDEEYFSNTSELAKDFIRRLLVKDPKRRMTIAQSLEHSWIKVSGEVGELPGLPALAFSLGSRGAFSI

SEQ ID NO: 23270 - protein, 158 aa, Homo sapiens
  Payload ID: 4639
  Gene Symbol: DAPK3
  Gene Name: death-associated protein kinase 3
  ENSP ID: ENSP00000471154
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIK

SEQ ID NO: 23271 - protein, 158 aa, Homo sapiens; identical to SEQ ID NO: 23270
  Payload ID: 4639
  Gene Symbol: DAPK3
  Gene Name: death-associated protein kinase 3
  ENSP ID: ENSP00000472988

SEQ ID NO: 23272 - protein, 740 aa, Homo sapiens
  Payload ID: 4640
  Gene Symbol: DAXX
  Gene Name: death-domain associated protein
  Uniprot ID: Q9UER7
  ENSP ID: ENSP00000266000
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 23273 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000363668

SEQ ID NO: 23274 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000372539

SEQ ID NO: 23275 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000372681

SEQ ID NO: 23276 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000382014

SEQ ID NO: 23277 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000382281

SEQ ID NO: 23278 - protein, 48 aa, Homo sapiens
  Payload ID: 4640
  Gene Symbol: DAXX
  Gene Name: death-domain associated protein
  ENSP ID: ENSP00000387575
MATANSIIVLDDDDEDEAAAQPGPSHPLPNAASPGAEAPSSSEPHGAR

SEQ ID NO: 23279 - protein, 48 aa, Homo sapiens; identical to SEQ ID NO: 23278
  Payload ID: 4640
  Gene Symbol: DAXX
  Gene Name: death-domain associated protein
  ENSP ID: ENSP00000390008

SEQ ID NO: 23280 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000394108

SEQ ID NO: 23281 - protein, 665 aa, Homo sapiens
  Payload ID: 4640
  Gene Symbol: DAXX
  Gene Name: death-domain associated protein
  Uniprot ID: Q9UER7
  ENSP ID: ENSP00000396876
MQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 23282 - protein, 129 aa, Homo sapiens
  Payload ID: 4640
  Gene Symbol: DAXX
  Gene Name: death-domain associated protein
  ENSP ID: ENSP00000397612
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINE

SEQ ID NO: 23283 - protein, 178 aa, Homo sapiens
  Payload ID: 4640
  Gene Symbol: DAXX
  Gene Name: death-domain associated protein
  ENSP ID: ENSP00000403986
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQS

SEQ ID NO: 23284 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000404376

SEQ ID NO: 23285 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000404623

SEQ ID NO: 23286 - protein, 178 aa, Homo sapiens; identical to SEQ ID NO: 23283
  Payload ID: 4640
  Gene Symbol: DAXX
  Gene Name: death-domain associated protein
  ENSP ID: ENSP00000406008

SEQ ID NO: 23287 - protein, 48 aa, Homo sapiens; identical to SEQ ID NO: 23278
  Payload ID: 4640
  Gene Symbol: DAXX
  Gene Name: death-domain associated protein
  ENSP ID: ENSP00000406649

SEQ ID NO: 23288 - protein, 48 aa, Homo sapiens; identical to SEQ ID NO: 23278
  Payload ID: 4640
  Gene Symbol: DAXX
  Gene Name: death-domain associated protein
  ENSP ID: ENSP00000407623

SEQ ID NO: 23289 - protein, 178 aa, Homo sapiens; identical to SEQ ID NO: 23283
  Payload ID: 4640
  Gene Symbol: DAXX
  Gene Name: death-domain associated protein
  ENSP ID: ENSP00000408215

SEQ ID NO: 23290 - protein, 129 aa, Homo sapiens; identical to SEQ ID NO: 23282
  Payload ID: 4640
  Gene Symbol: DAXX
  Gene Name: death-domain associated protein
  ENSP ID: ENSP00000408499

SEQ ID NO: 23291 - protein, 129 aa, Homo sapiens; identical to SEQ ID NO: 23282
  Payload ID: 4640
  Gene Symbol: DAXX
  Gene Name: death-domain associated protein
  ENSP ID: ENSP00000409756

SEQ ID NO: 23292 - protein, 740 aa, Homo sapiens; identical to SEQ ID NO: 23272
  Payload ID: 4640
  Gene Symbol: DAXX
  Gene Name: death-domain associated protein
  Uniprot ID: Q9UER7
  ENSP ID: ENSP00000410772

SEQ ID NO: 23293 - protein, 48 aa, Homo sapiens; identical to SEQ ID NO: 23278
  Payload ID: 4640
  Gene Symbol: DAXX
  Gene Name: death-domain associated protein
  ENSP ID: ENSP00000411119

SEQ ID NO: 23294 - protein, 129 aa, Homo sapiens; identical to SEQ ID NO: 23282
  Payload ID: 4640
  Gene Symbol: DAXX
  Gene Name: death-domain associated protein
  ENSP ID: ENSP00000411700

SEQ ID NO: 23295 - protein, 178 aa, Homo sapiens; identical to SEQ ID NO: 23283
  Payload ID: 4640
  Gene Symbol: DAXX
  Gene Name: death-domain associated protein
  ENSP ID: ENSP00000412177

SEQ ID NO: 23296 - protein, 129 aa, Homo sapiens; identical to SEQ ID NO: 23282
  Payload ID: 4640
  Gene Symbol: DAXX
  Gene Name: death-domain associated protein
  ENSP ID: ENSP00000412433

SEQ ID NO: 23297 - protein, 178 aa, Homo sapiens; identical to SEQ ID NO: 23283
  Payload ID: 4640
  Gene Symbol: DAXX
  Gene Name: death-domain associated protein
  ENSP ID: ENSP00000415898

SEQ ID NO: 23298 - protein, 688 aa, Homo sapiens
  Payload ID: 4640
  Gene Symbol: DAXX
  Gene Name: death-domain associated protein
  Uniprot ID: Q9UER7
  ENSP ID: ENSP00000477633
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQSPAVPNPPFTASSAWYLQDKCGHTMRSRRDHRALRL

SEQ ID NO: 23299 - protein, 688 aa, Homo sapiens; identical to SEQ ID NO: 23298
  Payload ID: 4640
  Gene Symbol: DAXX
  Gene Name: death-domain associated protein
  Uniprot ID: Q9UER7
  ENSP ID: ENSP00000478810

SEQ ID NO: 23300 - protein, 665 aa, Homo sapiens; identical to SEQ ID NO: 23281
  Payload ID: 4640
  Gene Symbol: DAXX
  Gene Name: death-domain associated protein
  Uniprot ID: Q9UER7
  ENSP ID: ENSP00000479172

SEQ ID NO: 23301 - protein, 665 aa, Homo sapiens; identical to SEQ ID NO: 23281
  Payload ID: 4640
  Gene Symbol: DAXX
  Gene Name: death-domain associated protein
  Uniprot ID: Q9UER7
  ENSP ID: ENSP00000480448

SEQ ID NO: 23302 - protein, 688 aa, Homo sapiens; identical to SEQ ID NO: 23298
  Payload ID: 4640
  Gene Symbol: DAXX
  Gene Name: death-domain associated protein
  Uniprot ID: Q9UER7
  ENSP ID: ENSP00000482399

SEQ ID NO: 23303 - protein, 665 aa, Homo sapiens; identical to SEQ ID NO: 23281
  Payload ID: 4640
  Gene Symbol: DAXX
  Gene Name: death-domain associated protein
  Uniprot ID: Q9UER7
  ENSP ID: ENSP00000483394

SEQ ID NO: 23304 - protein, 688 aa, Homo sapiens; identical to SEQ ID NO: 23298
  Payload ID: 4640
  Gene Symbol: DAXX
  Gene Name: death-domain associated protein
  Uniprot ID: Q9UER7
  ENSP ID: ENSP00000483517

SEQ ID NO: 23305 - protein, 688 aa, Homo sapiens; identical to SEQ ID NO: 23298
  Payload ID: 4640
  Gene Symbol: DAXX
  Gene Name: death-domain associated protein
  Uniprot ID: Q9UER7
  ENSP ID: ENSP00000484830

SEQ ID NO: 23306 - protein, 544 aa, Homo sapiens
  Payload ID: 4641
  Gene Symbol: DBR1
  Gene Name: debranching RNA lariats 1
  Uniprot ID: Q9UK59
  ENSP ID: ENSP00000260803
MRVAVAGCCHGELDKIYETLALAERRGPGPVDLLLCCGDFQAVRNEADLRCMAVPPKYRHMQTFYRYYSGEKKAPVLTLFIGGNHEASNHLQELPYGGWVAPNIYYLGLAGVVKYRGVRIGGISGIFKSHDYRKGHFECPPYNSSTIRSIYHVRNIEVYKLKQLKQPIDIFLSHDWPRSIYHYGNKKQLLKTKSFFRQEVENNTLGSPAASELLEHLKPTYWFSAHLHVKFAALMQHQAKDKGQTARATKFLALDKCLPHRDFLQILEIEHDPSAPDYLEYDIEWLTILRATDDLINVTGRLWNMPENNGLHARWDYSATEEGMKEVLEKLNHDLKVPCNFSVTAACYDPSKPQTQMQLIHRINPQTTEFCAQLGIIDINVRLQKSKEEHHVCGEYEEQDDVESNDSGEDQSEYNTDTSALSSINPDEIMLDEEEDEDSIVSAHSGMNTPSVEPSDQASEFSASFSDVRILPGSMIVSSDDTVDSTIDREGKPGGTVESGNGEDLTKVPLKRLSDEHEPEQRKKIKRRNQAIYAAVDDDDDDAA

SEQ ID NO: 23307 - protein, 118 aa, Homo sapiens
  Payload ID: 4641
  Gene Symbol: DBR1
  Gene Name: debranching RNA lariats 1
  ENSP ID: ENSP00000417262
MRVAVAGCCHGELDKIYETLALAERRGPGPVDLLLCCGDFQAVRNEADLRCMAVPPKYRHMQTFYRYYSGEKKAPVLTLFIGGNHEASNHLQELPYGGWVAPNIYYLAEAAYRYILVS

SEQ ID NO: 23308 - protein, 337 aa, Homo sapiens
  Payload ID: 4642
  Gene Symbol: DCPS
  Gene Name: decapping enzyme, scavenger
  Uniprot ID: Q96C86
  ENSP ID: ENSP00000263579
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 23309 - protein, 396 aa, Homo sapiens
  Payload ID: 4643
  Gene Symbol: DXO
  Gene Name: decapping exoribonuclease
  Uniprot ID: O77932
  ENSP ID: ENSP00000337759
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMHSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 23310 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000364498

SEQ ID NO: 23311 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000364505

SEQ ID NO: 23312 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000372820

SEQ ID NO: 23313 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000382818

SEQ ID NO: 23314 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000382819

SEQ ID NO: 23315 - protein, 396 aa, Homo sapiens
  Payload ID: 4643
  Gene Symbol: DXO
  Gene Name: decapping exoribonuclease
  Uniprot ID: O77932
  ENSP ID: ENSP00000391123
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMQSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 23316 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000391349

SEQ ID NO: 23317 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000391532

SEQ ID NO: 23318 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000394167

SEQ ID NO: 23319 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000395262

SEQ ID NO: 23320 - protein, 396 aa, Homo sapiens; identical to SEQ ID NO: 23315
  Payload ID: 4643
  Gene Symbol: DXO
  Gene Name: decapping exoribonuclease
  Uniprot ID: O77932
  ENSP ID: ENSP00000400173

SEQ ID NO: 23321 - protein, 396 aa, Homo sapiens; identical to SEQ ID NO: 23315
  Payload ID: 4643
  Gene Symbol: DXO
  Gene Name: decapping exoribonuclease
  Uniprot ID: O77932
  ENSP ID: ENSP00000401315

SEQ ID NO: 23322 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000406143

SEQ ID NO: 23323 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000410404

SEQ ID NO: 23324 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000411380

SEQ ID NO: 23325 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000413860

SEQ ID NO: 23326 - protein, 396 aa, Homo sapiens; identical to SEQ ID NO: 23309
  Payload ID: 4643
  Gene Symbol: DXO
  Gene Name: decapping exoribonuclease
  Uniprot ID: O77932
  ENSP ID: ENSP00000415675

SEQ ID NO: 23327 - protein, 210 aa, Homo sapiens
  Payload ID: 4643
  Gene Symbol: DXO
  Gene Name: decapping exoribonuclease
  ENSP ID: ENSP00000418632
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCAAAWEATLCSSQGR

SEQ ID NO: 23328 - protein, 174 aa, Homo sapiens
  Payload ID: 4643
  Gene Symbol: DXO
  Gene Name: decapping exoribonuclease
  ENSP ID: ENSP00000419588
  MOD_RES (1)..(1): Any amino acid
XMCADKPGSSPDPSGEVNTNVAFCSVLRSRLGSHPLLFSGEVDCTDPQAPSTQPPTCYVELKTSKEMHSPGQWRSFYRFRIGTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 23329 - protein, 544 aa, Homo sapiens
  Payload ID: 4644
  Gene Symbol: DCP1A
  Gene Name: decapping mRNA 1A
  Uniprot ID: Q9NPI6
  ENSP ID: ENSP00000476046
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 23330 - protein, 582 aa, Homo sapiens
  Payload ID: 4644
  Gene Symbol: DCP1A
  Gene Name: decapping mRNA 1A
  Uniprot ID: Q9NPI6
  ENSP ID: ENSP00000476386
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSETLGVPSAAHHSVQPEITTPVLITPASITQSNEKHAPTYTIPLSPVLSPTLPAEAPTAQVPPSLPRNSTMMQAVKTTPRQRSPLLNQPVPELSHASLIANQSPFRAPLNVTNTAGTSLPSVDLLQKLRLTPQHDQIQTQPLGKGAMVASFSPAAGQLATPESFIEPPSKTAAARVAASASLSNMVLAPLQSMQQNQDPEVFVQPKVLSSAIPVAGAPLVTATTTAVSSVLLAPSVFQQTVTRSSDLERKASSPSPLTIGTPESQRKPSIILSKSQLQDTLIHLIKNDSSFLSTLHEVYLQVLTKNKDNHNL

SEQ ID NO: 23331 - protein, 260 aa, Homo sapiens
  Payload ID: 4644
  Gene Symbol: DCP1A
  Gene Name: decapping mRNA 1A
  ENSP ID: ENSP00000477594
MEALSRAGQEMSLAALKQHDPYITSIADLTGQEKTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLGSTETLEEMPSGSQDKSAPSGHKHLTVEELFGTSLPKEQPAVVGLDSEEMERLPGDASQKEPNSFLPFPFEQLGGAPQSET

SEQ ID NO: 23332 - protein, 191 aa, Homo sapiens
  Payload ID: 4644
  Gene Symbol: DCP1A
  Gene Name: decapping mRNA 1A
  ENSP ID: ENSP00000479387
MEALSRAGQEMSLAALKQHDPYITSIADLTGQVALYTFCPKANQWTDIEGTLFVYRRSASPYHGFTIVNRLNMHNLVEPVNKDLEFQLHEPFLLYRNASLSIYSIWFYDKNDCHRIAKLMADVVEEETRRSQQAARDKQSPSQANGCSDHRPIDILEMLSRAKDEYERNQMGDSNISSPGLQPSTQLSNLG

SEQ ID NO: 23333 - protein, 102 aa, Homo sapiens
  Payload ID: 4644
  Gene Symbol: DCP1A
  Gene Name: decapping mRNA 1A
  ENSP ID: ENSP00000480912
MEALSRAGQEMSLAALKQHDPYITSIADLTGQVALYTFCPKANQWEKTDIEGTLFVYRRSASPYHGFTIVNRLNMHNLVEPVNKDLEFQLHEPFLLYRNASC

SEQ ID NO: 23334 - protein, 617 aa, Homo sapiens
  Payload ID: 4645
  Gene Symbol: DCP1B
  Gene Name: decapping mRNA 1B
  Uniprot ID: Q8IZD4
  ENSP ID: ENSP00000280665
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 23335 - protein, 390 aa, Homo sapiens
  Payload ID: 4645
  Gene Symbol: DCP1B
  Gene Name: decapping mRNA 1B
  ENSP ID: ENSP00000444374
MKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQYSQISRAE

SEQ ID NO: 23336 - protein, 119 aa, Homo sapiens
  Payload ID: 4645
  Gene Symbol: DCP1B
  Gene Name: decapping mRNA 1B
  ENSP ID: ENSP00000445011
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARYEETETPVRRQTV

SEQ ID NO: 23337 - protein, 153 aa, Homo sapiens
  Payload ID: 4645
  Gene Symbol: DCP1B
  Gene Name: decapping mRNA 1B
  ENSP ID: ENSP00000482714
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARCESFLLQWVVLLLKFGQVFKIVQCLPLCLHLVSVAMGGVSILTNVNV

SEQ ID NO: 23338 - protein, 420 aa, Homo sapiens
  Payload ID: 4646
  Gene Symbol: DCP2
  Gene Name: decapping mRNA 2
  Uniprot ID: Q8IU60
  ENSP ID: ENSP00000373715
METKRVEIPGSVLDDLCSRFILHIPSEERDNAIRVCFQIELAHWFYLDFYMQNTPGLPQCGIRDFAKAVFSHCPFLLPQGEDVEKVLDEWKEYKMGVPTYGAIILDETLENVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 23339 - protein, 402 aa, Homo sapiens
  Payload ID: 4646
  Gene Symbol: DCP2
  Gene Name: decapping mRNA 2
  ENSP ID: ENSP00000424982
  MOD_RES (1)..(1): Any amino acid
XGAPPRALAQSWGPRLRERDGSERVPPLPLLVSVGVVSAAASSAASSPASRSPSAVPSVPGRAEPGCTVPAVGPHHGDQTGGDSRQRPGRSLQVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 23340 - protein, 385 aa, Homo sapiens
  Payload ID: 4646
  Gene Symbol: DCP2
  Gene Name: decapping mRNA 2
  Uniprot ID: Q8IU60
  ENSP ID: ENSP00000425770
METKRVEIPGSVLDDLCSRFILHIPSEERDNAIRVCFQIELAHWFYLDFYMQNTPGLPQCGIRDFAKAVFSHCPFLLPQGEDVEKVLDEWKEYKMGVPTYGAIILDETLENVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKKCEKKLHPRKLQDNFETDAVYDLPSSSEDQLLEHAEGQPVACNGHCKFPFSSRAFLSFKFDHNAIMKILDL

SEQ ID NO: 23341 - protein, 74 aa, Homo sapiens
  Payload ID: 4646
  Gene Symbol: DCP2
  Gene Name: decapping mRNA 2
  ENSP ID: ENSP00000427198
MIVLLERSLKKLVLISKTIFVRMITLNFESMTSLLVCTSFQEFQKTQNLTQKLEEKFGTLSGSLLRNCLVIEMI

SEQ ID NO: 23342 - protein, 359 aa, Homo sapiens
  Payload ID: 4647
  Gene Symbol: DCN
  Gene Name: decorin
  Uniprot ID: P07585
  ENSP ID: ENSP00000052754
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 23343 - protein, 359 aa, Homo sapiens; identical to SEQ ID NO: 23342
  Payload ID: 4647
  Gene Symbol: DCN
  Gene Name: decorin
  Uniprot ID: P07585
  ENSP ID: ENSP00000376862

SEQ ID NO: 23344 - protein, 75 aa, Homo sapiens
  Payload ID: 4647
  Gene Symbol: DCN
  Gene Name: decorin
  Uniprot ID: P07585
  ENSP ID: ENSP00000398514
MKATIILLLLAQVSWAGPFQQRGLFDFMLEDEASGIGPEVPDDRDFEPSLGPVCPFRCQCHLRVVQCSDLGCLPS

SEQ ID NO: 23345 - protein, 172 aa, Homo sapiens
  Payload ID: 4647
  Gene Symbol: DCN
  Gene Name: decorin
  Uniprot ID: P07585
  ENSP ID: ENSP00000399815
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHVVYLHNNNISVVGSSDFCPPGHNTKKASYSGVSLFSNPVQYWEIQPSTFRCVYVRSAIQLGNYK

SEQ ID NO: 23346 - protein, 212 aa, Homo sapiens
  Payload ID: 4647
  Gene Symbol: DCN
  Gene Name: decorin
  Uniprot ID: P07585
  ENSP ID: ENSP00000401021
MKATIILLLLAQVSWAGPFQQRGLFDFMLEDEASGIGPEVPDDRDFEPSLGPVCPFRCQCHLRVVQCSDLGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 23347 - protein, 250 aa, Homo sapiens
  Payload ID: 4647
  Gene Symbol: DCN
  Gene Name: decorin
  Uniprot ID: P07585
  ENSP ID: ENSP00000413723
MKATIILLLLAQVSWAGPFQQRGLFDFMLEDEASGIGPEVPDDRDFEPSLGPVCPFRCQCHLRVVQCSDLELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 23348 - protein, 88 aa, Homo sapiens
  Payload ID: 4647
  Gene Symbol: DCN
  Gene Name: decorin
  ENSP ID: ENSP00000446527
MKATIILLLLAQVSWAGPFQQRGLFDFMLEDEASGIGPEVPDDRDFEPSLGPVCPFRCQCHLRVVQCSDLVETGFHRVSQDGLDLLIS

SEQ ID NO: 23349 - protein, 177 aa, Homo sapiens
  Payload ID: 4647
  Gene Symbol: DCN
  Gene Name: decorin
  ENSP ID: ENSP00000446530
MKATIILLLLAQVSWAGPFQQRGLFDFMLEDEASGIGPEVPDDRDFEPSLGPVCPFRCQCHLRVVQCSDLGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASY

SEQ ID NO: 23350 - protein, 359 aa, Homo sapiens; identical to SEQ ID NO: 23342
  Payload ID: 4647
  Gene Symbol: DCN
  Gene Name: decorin
  Uniprot ID: P07585
  ENSP ID: ENSP00000447654

SEQ ID NO: 23351 - protein, 212 aa, Homo sapiens; identical to SEQ ID NO: 23346
  Payload ID: 4647
  Gene Symbol: DCN
  Gene Name: decorin
  Uniprot ID: P07585
  ENSP ID: ENSP00000447674

SEQ ID NO: 23352 - protein, 178 aa, Homo sapiens
  Payload ID: 4647
  Gene Symbol: DCN
  Gene Name: decorin
  ENSP ID: ENSP00000447886
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIV

SEQ ID NO: 23353 - protein, 98 aa, Homo sapiens
  Payload ID: 4647
  Gene Symbol: DCN
  Gene Name: decorin
  ENSP ID: ENSP00000448057
MKATIILLLLAQVSWAGPFQQRGLFDFMLEDEASGIGPEVPDDRDFEPSLGPVCPFRCQCHLRVVQCSDLEKKYCNNLSSYNLYTTNCLILCRLFTHH

SEQ ID NO: 23354 - protein, 100 aa, Homo sapiens
  Payload ID: 4647
  Gene Symbol: DCN
  Gene Name: decorin
  ENSP ID: ENSP00000448274
MKATIILLLLAQVSWAGPFQQRGLFDFMLEDEASGIGPEVPDDRDFEPSLGPVCPFRCQCHLRVVQCSDLEKFGLEIPRALHLEDKSPERLKLSGWAKGE

SEQ ID NO: 23355 - protein, 52 aa, Homo sapiens
  Payload ID: 4647
  Gene Symbol: DCN
  Gene Name: decorin
  ENSP ID: ENSP00000448853
  MOD_RES (1)..(1): Any amino acid
XDFCPPGHNTKKASYSGVSLFSNPVQYWEIQPSTFRCVYVRSAIQLGNYKKK

SEQ ID NO: 23356 - protein, 98 aa, Homo sapiens; identical to SEQ ID NO: 23353
  Payload ID: 4647
  Gene Symbol: DCN
  Gene Name: decorin
  ENSP ID: ENSP00000448857

SEQ ID NO: 23357 - protein, 174 aa, Homo sapiens
  Payload ID: 4647
  Gene Symbol: DCN
  Gene Name: decorin
  ENSP ID: ENSP00000449014
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLN

SEQ ID NO: 23358 - protein, 95 aa, Homo sapiens
  Payload ID: 4647
  Gene Symbol: DCN
  Gene Name: decorin
  ENSP ID: ENSP00000449408
  MOD_RES (1)..(1): Any amino acid
XKISRVDAASLKGLNNLAKLGLSFNSISAVDNGSLANTPHLRELHLDNNKLTRVPGGLAEHKYIQVMQSHCLCEEYPKSKTPTLLMGCWEAGSSS

SEQ ID NO: 23359 - protein, 119 aa, Homo sapiens
  Payload ID: 4647
  Gene Symbol: DCN
  Gene Name: decorin
  ENSP ID: ENSP00000449438
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISK

SEQ ID NO: 23360 - protein, 179 aa, Homo sapiens
  Payload ID: 4647
  Gene Symbol: DCN
  Gene Name: decorin
  ENSP ID: ENSP00000449782
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVI

SEQ ID NO: 23361 - protein, 1865 aa, Homo sapiens
  Payload ID: 4648
  Gene Symbol: DOCK1
  Gene Name: dedicator of cytokinesis 1
  Uniprot ID: Q14185
  ENSP ID: ENSP00000280333
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQASVDSGIVQ

SEQ ID NO: 23362 - protein, 1886 aa, Homo sapiens
  Payload ID: 4648
  Gene Symbol: DOCK1
  Gene Name: dedicator of cytokinesis 1
  ENSP ID: ENSP00000485033
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPLALDDAIRHKPLNMSSRFSPRVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQASVDSGIVQ

SEQ ID NO: 23363 - protein, 2186 aa, Homo sapiens
  Payload ID: 4649
  Gene Symbol: DOCK10
  Gene Name: dedicator of cytokinesis 10
  Uniprot ID: Q96BY6
  ENSP ID: ENSP00000258390
MAGERTRRFTRSLLRPGQAAELRHSAASAAAVAVSSRQQQRQEKPRLLEPLDYETVIEELEKTYRNDPLQDLLFFPSDDFSAATVSWDIRTLYSTVPEDAEHKAENLLVKEACKFYSSQWHVVNYKYEQYSGDIRQLPRAEYKPEKLPSHSFEIDHEDADKDEDTTSHSSSKGGGGAGGTGVFKSGWLYKGNFNSTVNNTVTVRSFKKRYFQLTQLPDNSYIMNFYKDEKISKEPKGCIFLDSCTGVVQNNRLRKYAFELKMNDLTYFVLAAETESDMDEWIHTLNRILQISPEGPLQGRRSTELTDLGLDSLDNSVTCECTPEETDSSENNLHADFAKYLTETEDTVKTTRNMERLNLFSLDPDIDTLKLQKKDLLEPESVIKPFEEKAAKRIMIICKALNSNLQGCVTENENDPITNIEPFFVSVALYDLRDSRKISADFHVDLNHAAVRQMLLGASVALENGNIDTITPRQSEEPHIKGLPEEWLKFPKQAVFSVSNPHSEIVLVAKIEKVLMGNIASGAEPYIKNPDSNKYAQKILKSNRQFCSKLGKYRMPFAWAVRSVFKDNQGNVDRDSRFSPLFRQESSKISTEDLVKLVSDYRRADRISKMQTIPGSLDIAVDNVPLEHPNCVTSSFIPVKPFNMMAQTEPTVEVEEFVYDSTKYCRPYRVYKNQIYIYPKHLKYDSQKCFNKARNITVCIEFKNSDEESAKPLKCIYGKPGGPLFTSAAYTAVLHHSQNPDFSDEVKIELPTQLHEKHHILFSFYHVTCDINAKANAKKKEALETSVGYAWLPLMKHDQIASQEYNIPIATSLPPNYLSFQDSASGKHGGSDIKWVDGGKPLFKVSTFVVSTVNTQDPHVNAFFQECQKREKDMSQSPTSNFIRSCKNLLNVEKIHAIMSFLPIILNQLFKVLVQNEEDEITTTVTRVLTDIVAKCHEEQLDHSVQSYIKFVFKTRACKERTVHEELAKNVTGLLKSNDSTTVKHVLKHSWFFFAIILKSMAQHLIDTNKIQLPRPQRFPESYQNELDNLVMVLSDHVIWKYKDALEETRRANHSVARFLKRCFTFMDRGYVFKMVNNYISMFSSGDLKTLCQYKFDFLQEVCQHEHFIPLCLPIRSANIPDPLTPSESTQELHASDMPEYSVTNEFCRKHFLIGILLREVGFALQEDQDVRHLALAVLKNLMAKHSFDDRYREPRKQAQIASLYMPLYGMLLDNMPRIYLKDLYPFTVNTSNQGSRDDLSTNGGFQSQTAIKHANSVDTSFSKDVLNSIAAFSSIAISTVNHADSRASLASLDSNPSTNEKSSEKTDNCEKIPRPLSLIGSTLRFDKLDQAETRSLLMCFLHIMKTISYETLIAYWQRAPSPEVSDFFSILDVCLQNFRYLGKRNIIRKIAAAFKFVQSTQNNGTLKGSNPSCQTSGLLSQWMHSTSSHEGHKQHRSQTLPIIRGKNALSNPKLLQMLDNTMTSNSNEIDIVHHVDTEANIATEVCLTILDLLSLFTQTHQRQLQQCDCQNSLMKRVFDTYMLFFQVNQSATALKHVFASLRLFVCKFPSAFFQGPADLCGSFCYEVLKCCNHRSRSTQTEASALLYFFMRKNFEFNKQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGYWKVEKICTASLLSEDTHPCDSNSLLTTPSGGSMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 23364 - protein, 2180 aa, Homo sapiens
  Payload ID: 4649
  Gene Symbol: DOCK10
  Gene Name: dedicator of cytokinesis 10
  Uniprot ID: Q96BY6
  ENSP ID: ENSP00000386694
MSFRGKVFKREPSEFWKKRRTVRRVNQEEIHRFSSQEKPRLLEPLDYETVIEELEKTYRNDPLQDLLFFPSDDFSAATVSWDIRTLYSTVPEDAEHKAENLLVKEACKFYSSQWHVVNYKYEQYSGDIRQLPRAEYKPEKLPSHSFEIDHEDADKDEDTTSHSSSKGGGGAGGTGVFKSGWLYKGNFNSTVNNTVTVRSFKKRYFQLTQLPDNSYIMNFYKDEKISKEPKGCIFLDSCTGVVQNNRLRKYAFELKMNDLTYFVLAAETESDMDEWIHTLNRILQISPEGPLQGRRSTELTDLGLDSLDNSVTCECTPEETDSSENNLHADFAKYLTETEDTVKTTRNMERLNLFSLDPDIDTLKLQKKDLLEPESVIKPFEEKAAKRIMIICKALNSNLQGCVTENENDPITNIEPFFVSVALYDLRDSRKISADFHVDLNHAAVRQMLLGASVALENGNIDTITPRQSEEPHIKGLPEEWLKFPKQAVFSVSNPHSEIVLVAKIEKVLMGNIASGAEPYIKNPDSNKYAQKILKSNRQFCSKLGKYRMPFAWAVRSVFKDNQGNVDRDSRFSPLFRQESSKISTEDLVKLVSDYRRADRISKMQTIPGSLDIAVDNVPLEHPNCVTSSFIPVKPFNMMAQTEPTVEVEEFVYDSTKYCRPYRVYKNQIYIYPKHLKYDSQKCFNKARNITVCIEFKNSDEESAKPLKCIYGKPGGPLFTSAAYTAVLHHSQNPDFSDEVKIELPTQLHEKHHILFSFYHVTCDINAKANAKKKEALETSVGYAWLPLMKHDQIASQEYNIPIATSLPPNYLSFQDSASGKHGGSDIKWVDGGKPLFKVSTFVVSTVNTQDPHVNAFFQECQKREKDMSQSPTSNFIRSCKNLLNVEKIHAIMSFLPIILNQLFKVLVQNEEDEITTTVTRVLTDIVAKCHEEQLDHSVQSYIKFVFKTRACKERTVHEELAKNVTGLLKSNDSTTVKHVLKHSWFFFAIILKSMAQHLIDTNKIQLPRPQRFPESYQNELDNLVMVLSDHVIWKYKDALEETRRANHSVARFLKRCFTFMDRGYVFKMVNNYISMFSSGDLKTLCQYKFDFLQEVCQHEHFIPLCLPIRSANIPDPLTPSESTQELHASDMPEYSVTNEFCRKHFLIGILLREVGFALQEDQDVRHLALAVLKNLMAKHSFDDRYREPRKQAQIASLYMPLYGMLLDNMPRIYLKDLYPFTVNTSNQGSRDDLSTNGGFQSQTAIKHANSVDTSFSKDVLNSIAAFSSIAISTVNHADSRASLASLDSNPSTNEKSSEKTDNCEKIPRPLSLIGSTLRFDKLDQAETRSLLMCFLHIMKTISYETLIAYWQRAPSPEVSDFFSILDVCLQNFRYLGKRNIIRKIAAAFKFVQSTQNNGTLKGSNPSCQTSGLLSQWMHSTSSHEGHKQHRSQTLPIIRGKNALSNPKLLQMLDNTMTSNSNEIDIVHHVDTEANIATEVCLTILDLLSLFTQTHQRQLQQCDCQNSLMKRVFDTYMLFFQVNQSATALKHVFASLRLFVCKFPSAFFQGPADLCGSFCYEVLKCCNHRSRSTQTEASALLYFFMRKNFEFNKQKSIVRSHLQLIKAVSQLIADAGIGGSRFQHSLAITNNFANGDKQMKNSNFPAEVKDLTKRIRTVLMATAQMKEHEKDPEMLVDLQYSLANSYASTPELRRTWLESMAKIHARNGDLSEAAMCYIHIAALIAEYLKRKGYWKVEKICTASLLSEDTHPCDSNSLLTTPSGGSMFSMGWPAFLSITPNIKEEGAMKEDSGMQDTPYNENILVEQLYMCVEFLWKSERYELIADVNKPIIAVFEKQRDFKKLSDLYYDIHRSYLKVAEVVNSEKRLFGRYYRVAFYGQGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKVSELNQLCTMEEVDMIRLQLKLQGSVSVKVNAGPMAYARAFLEETNAKKYPDNQVKLLKEIFRQFADACGQALDVNERLIKEDQLEYQEELRSHYKDMLSELSTVMNEQITGRDDLSKRGVDQTCTRVISKATPALPTVSISSSAEV

SEQ ID NO: 23365 - protein, 142 aa, Homo sapiens [sequence omitted]

SEQ ID NO: 23366 - protein, 380 aa, Homo sapiens
  Payload ID: 4649
  Gene Symbol: DOCK10
  Gene Name: dedicator of cytokinesis 10
  ENSP ID: ENSP00000395178
  MOD_RES (1)..(1): Any amino acid
XLCLPIRSANIPDPLTPSESTQELHASDMPEYSVTNEFCRKHFLIGILLREVGFALQEDQDVRHLALAVLKNLMAKHSFDDRYREPRKQAQIASLYMPLYGMLLDNMPRIYLKDLYPFTVNTSNQGSRDDLSTNGGFQSQTAIKHANSVDTSFSKDVLNSIAVNHADSRASLASLDSNPSTNEKSSEKTDNCEKIPRPLSLIGSTLRFDKLDQAETRSLLMCFLHIMKTISYETLIAYWQRAPSPEVSDFFSILDVCLQNFRYLGKRNIIRKIAAAFKFVQSTQNNGTLKGSNPSCQTSGLLSQWMHSTSSHEGHKQHRSQTLPIIRGKNALSNPKLLQMLDNTMTSNSNEIDIVHHVDTEANIATEVCLTILDLLSLFT

SEQ ID NO: 23367 - protein, 42 aa, Homo sapiens
  Payload ID: 4649
  Gene Symbol: DOCK10
  Gene Name: dedicator of cytokinesis 10
  ENSP ID: ENSP00000397389
MAGERTRRFTRSLLRPGQAAELRHSAASAAAVAVSSRQQQRH

SEQ ID NO: 23368 - protein, 190 aa, Homo sapiens
  Payload ID: 4649
  Gene Symbol: DOCK10
  Gene Name: dedicator of cytokinesis 10
  ENSP ID: ENSP00000437947
  MOD_RES (1)..(1): Any amino acid
XYDIHRSYLKVAEVVNSEKRLFGRYYRVAFYGQAVGFFEEEEGKEYIYKEPKLTGLSEISQRLLKLYADKFGADNVKIIQDSNKVNPKDLDPKYAYIQVTYVTPFFEEKEIEDRKTDFEMHHNINRFVFETPFTLSGKKHGGVAEQCKRRTILTTSHLFPYVKKRIQVISQSSTELNPIEVAIDEMSKKV

SEQ ID NO: 23369 - protein, 2073 aa, Homo sapiens
  Payload ID: 4650
  Gene Symbol: DOCK11
  Gene Name: dedicator of cytokinesis 11
  Uniprot ID: Q5JSL3
  ENSP ID: ENSP00000276202
MAEVRKFTKRLSKPGTAAELRQSVSEAVRGSVVLEKAKVVEPLDYENVIAQRKTQIYSDPLRDLLMFPMEDISISVIGRQRRTVQSTVPEDAEKRAQSLFVKECIKTYSTDWHVVNYKYEDFSGDFRMLPCKSLRPEKIPNHVFEIDEDCEKDEDSSSLCSQKGGVIKQGWLHKANVNSTITVTMKVFKRRYFYLTQLPDGSYILNSYKDEKNSKESKGCIYLDACIDVVQCPKMRRHAFELKMLDKYSHYLAAETEQEMEEWLITLKKIIQINTDSLVQEKKETVETAQDDETSSQGKAENIMASLERSMHPELMKYGRETEQLNKLSRGDGRQNLFSFDSEVQRLDFSGIEPDIKPFEEKCNKRFLVNCHDLTFNILGQIGDNAKGPPTNVEPFFINLALFDVKNNCKISADFHVDLNPPSVREMLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSNCITSSYVPLKPFEKNCQNITVEVEEFVPEMTKYCYPFTIYKNHLYVYPLQLKYDSQKTFAKARNIAVCVEFRDSDESDASALKCIYGKPAGSVFTTNAYAVVSHHNQNPEFYDEIKIELPIHLHQKHHLLFTFYHVSCEINTKGTTKKQDTVETPVGFAWVPLLKDGRIITFEQQLPVSANLPPGYLNLNDAESRRQCNVDIKWVDGAKPLLKIKSHLESTIYTQDLHVHKFFHHCQLIQSGSKEVPGELIKYLKCLHAMEIQVMIQFLPVILMQLFRVLTNMTHEDDVPINCTMVLLHIVSKCHEEGLDSYLRSFIKYSFRPEKPSAPQAQLIHETLATTMIAILKQSADFLSINKLLKYSWFFFEIIAKSMATYLLEENKIKLPRGQRFPETYHHVLHSLLLAIIPHVTIRYAEIPDESRNVNYSLASFLKRCLTLMDRGFIFNLINDYISGFSPKDPKVLAEYKFEFLQTICNHEHYIPLNLPMAFAKPKLQRVQDSNLEYSLSDEYCKHHFLVGLLLRETSIALQDNYEIRYTAISVIKNLLIKHAFDTRYQHKNQQAKIAQLYLPFVGLLLENIQRLAGRDTLYSCAAMPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 23370 - protein, 2077 aa, Homo sapiens
  Payload ID: 4650
  Gene Symbol: DOCK11
  Gene Name: dedicator of cytokinesis 11
  ENSP ID: ENSP00000276204
MAEVRKFTKRLSKPGTAAELRQSVSEAVRGSVVLEKAKVVEPLDYENVIAQRKTQIYSDPLRDLLMFPMEDISISVIGRQRRTVQSTVPEDAEKRAQSLFVKECIKTYSTDWHVVNYKYEDFSGDFRMLPCKSLRPEKIPNHVFEIDEDCEKDEDSSSLCSQKGGVIKQGWLHKANVNSTITVTMKVFKRRYFYLTQLPDGSYILNSYKDEKNSKESKGCIYLDACIDVVQCPKMRRHAFELKMLDKYSHYLAAETEQEMEEWLITLKKIIQINTDSLVQEKKETVETAQDDETSSQGKAENIMASLERSMHPELMKYGRETEQLNKLSRGDGRQNLFSFDSEVQRLDFSGIEPDIKPFEEKCNKRFLVNCHDLTFNILGQIGDNAKGPPTNVEPFFINLALFDVKNNCKISADFHVDLNPPSVREMLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSNCITSSYVPLKPFEKNCQNITVEVEEFVPEMTKYCYPFTIYKNHLYVYPLQLKYDSQKTFAKARNIAVCVEFRDSDESDASALKCIYGKPAGSVFTTNAYAVVSHHNQNPEFYDEIKIELPIHLHQKHHLLFTFYHVSCEINTKGTTKKQDTVETPVGFAWVPLLKDGRIITFEQQLPVSANLPPGYLNLNDAESRRQCNVDIKWVDGAKPLLKIKSHLESTIYTQDLHVHKFFHHCQLIQSGSKEVPGELIKYLKCLHAMEIQVMIQFLPVILMQLFRVLTNMTHEDDVPINCTMVLLHIVSKCHEEGLDSYLRSFIKYSFRPEKPSAPQAQLIHETLATTMIAILKQSADFLSINKLLKYSWFFFEIIAKSMATYLLEENKIKLPRGQRFPETYHHVLHSLLLAIIPHVTIRYAEIPDESRNVNYSLASFLKRCLTLMDRGFIFNLINDYISGFSPKDPKVLAEYKFEFLQTICNHEHYIPLNLPMAFAKPKLQRVQDSNLEYSLSDEYCKHHFLVGLLLRETSIALQDNYEIRYTAISVIKNLLIKHAFDTRYQHKNQQAKIAQLYLPFVGLLLENIQRLAGRDTLYSCAAMPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQASIRILQEDTMHSPWMSNTLHVFCAISGTSSDRGYGSPRYAEV

SEQ ID NO: 23371 - protein, 1902 aa, Homo sapiens
  Payload ID: 4650
  Gene Symbol: DOCK11
  Gene Name: dedicator of cytokinesis 11
  ENSP ID: ENSP00000487829
MKVFKRRYFYLTQLPDGSYILNSYKDEKNSKESKGCIYLDACIDVVQCPKMRRHAFELKMLDKYSHYLAAETEQEMEEWLITLKKIIQINTDSLVQEKKETVETAQDDETSSQGKAENIMASLERSMHPELMKYGRETEQLNKLSRGDGRQNLFSFDSEVQRLDFSGIEPDIKPFEEKCNKRFLVNCHDLTFNILGQIGDNAKGPPTNVEPFFINLALFDVKNNCKISADFHVDLNPPSVREMLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSNCITSSYVPLKPFEKNCQNITVEVEEFVPEMTKYCYPFTIYKNHLYVYPLQLKYDSQKTFAKARNIAVCVEFRDSDESDASALKCIYGKPAGSVFTTNAYAVVSHHNQNPEFYDEIKIELPIHLHQKHHLLFTFYHVSCEINTKGTTKKQDTVETPVGFAWVPLLKDGRIITFEQQLPVSANLPPGYLNLNDAESRRQCNVDIKWVDGAKPLLKIKSHLESTIYTQDLHVHKFFHHCQLIQSGSKEVPGELIKYLKCLHAMEIQVMIQFLPVILMQLFRVLTNMTHEDDVPINCTMVLLHIVSKCHEEGLDSYLRSFIKYSFRPEKPSAPQAQLIHETLATTMIAILKQSADFLSINKLLKYSWFFFEIIAKSMATYLLEENKIKLPRGQRFPETYHHVLHSLLLAIIPHVTIRYAEIPDESRNVNYSLASFLKRCLTLMDRGFIFNLINDYISGFSPKDPKVLAEYKFEFLQTICNHEHYIPLNLPMAFAKPKLQRVQDFFSFAVDRLTSVDSNLEYSLSDEYCKHHFLVGLLLRETSIALQDNYEIRYTAISVIKNLLIKHAFDTRYQHKNQQAKIAQLYLPFVGLLLENIQRLAGRDTLYSCAAMPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 23372 - protein, 40 aa, Homo sapiens
  Payload ID: 4650
  Gene Symbol: DOCK11
  Gene Name: dedicator of cytokinesis 11
  ENSP ID: ENSP00000488503
  MOD_RES (1)..(1): Any amino acid
XALELNERLIKEDQVEYHEGLKSNFRDMVKELSDIIHEQL

SEQ ID NO: 23373 - protein, 1830 aa, Homo sapiens
  Payload ID: 4651
  Gene Symbol: DOCK2
  Gene Name: dedicator of cytokinesis 2
  Uniprot ID: Q92608
  ENSP ID: ENSP00000256935
MAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 23374 - protein, 55 aa, Homo sapiens
  Payload ID: 4651
  Gene Symbol: DOCK2
  Gene Name: dedicator of cytokinesis 2
  ENSP ID: ENSP00000393451
LWNNYFHLAVAFITQDSLQLEQFSHAKYNKILNKSEQNLLHPRHGRTYIRDDTYP

SEQ ID NO: 23375 - protein, 161 aa, Homo sapiens
  Payload ID: 4651
  Gene Symbol: DOCK2
  Gene Name: dedicator of cytokinesis 2
  ENSP ID: ENSP00000428841
KYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILIDAADDRTEPIGCYGVLNVIVSAKG

SEQ ID NO: 23376 - protein, 1031 aa, Homo sapiens
  Payload ID: 4651
  Gene Symbol: DOCK2
  Gene Name: dedicator of cytokinesis 2
  ENSP ID: ENSP00000428850
MAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQGFSRTGM

SEQ ID NO: 23377 - protein, 1322 aa, Homo sapiens
  Payload ID: 4651
  Gene Symbol: DOCK2
  Gene Name: dedicator of cytokinesis 2
  ENSP ID: ENSP00000429283
MSIAPLCTIKSNSHAGWKQSRWLSLLKTCRGSICDSCFDIGHLWNGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 23378 - protein, 335 aa, Homo sapiens
  Payload ID: 4651
  Gene Symbol: DOCK2
  Gene Name: dedicator of cytokinesis 2
  ENSP ID: ENSP00000438827
MCVCAEDGKTLPVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILIGACCNCGFPSSTPHSLIQWLWG

SEQ ID NO: 23379 - protein, 2030 aa, Homo sapiens
  Payload ID: 4652
  Gene Symbol: DOCK3
  Gene Name: dedicator of cytokinesis 3
  Uniprot ID: Q8IZD9
  ENSP ID: ENSP00000266037
MWTPTEEEKYGVVICSFRGSVPQGLVLEIGETVQILEKCEGWYRGVSTKKPNVKGIFPANYIHLKKAIVSNRGQYETVVPLEDSIVTEVTATLQEWASLWKQLYVKHKVDLFYKLRHVMNELIDLRRQLLSGHLTQDQVREVKRHITVRLDWGNEHLGLDLVPRKDFEVVDSDQISVSDLYKMHLSSRQSVQQSTSQVDTMRPRHGETCRMPVPHHFFLSLKSFTYNTIGEDTDVFFSLYDMREGKQISERFLVRLNKNGGPRNPEKIERMCALFTDLSSKDMKRDLYIVAHVIRIGRMLLNDSKKGPPHLHYRRPYGCAVLSILDVLQSLTEVKEEKDFVLKVYTCNNESEWSQIHENIIRKSSAKYSAPSASHGLIISLQLLRGDMEQIRRENPMIFNRGLAITRKLGFPDVIMPGDIRNDLYLTLEKGDFERGGKSVQKNIEVTMYVLYADGEILKDCISLGSGEPNRSSYHSFVLYHSNSPRWGEIIKLPIPIDRFRGSHLRFEFRHCSTKDKGEKKLFGFAFSTLMRDDGTTLSDDIHELYVYKCDENSTFNNHALYLGLPCCKEDYNGCPNIPSSLIFQRSTKESFFISTQLSSTKLTQNVDLLALLKWKAFPDRIMDVLGRLRHVSGEEIVKFLQDILDTLFVILDDNTEKYGLLVFQSLVFIINLLRDIKYFHFRPVMDTYIQKHFAGALAYKELIRCLKWYMDCSAELIRQDHIQEAMRALEYLFKFIVQSRILYSRATCGMEEEQFRSSIQELFQSIRFVLSLDSRNSETLLFTQAALLNSFPTIFDELLQMFTVQEVAEFVRGTLGSMPSTVHIGQSMDVVKLQSIARTVDSRLFSFSESRRILLPVVLHHIHLHLRQQKELLICSGILGSIFSIVKTSSLEADVMEEVEMMVESLLDVLLQTLLTIMSKSHAQEAVRGQRCPQCTAEITGEYVSCLLSLLRQMCDTHFQHLLDNFQSKDELKEFLLKIFCVFRNLMKMSVFPRDWMVMRLLTSNIIVTTVQYLSSALHKNFTETDFDFKVWNSYFSLAVLFINQPSLQLEIITSAKRKKILDKYGDMRVMMAYELFSMWQNLGEHKIHFIPGMIGPFLGVTLVPQPEVRNIMIPIFHDMMDWEQRKNGNFKQVEAELIDKLDSMVSEGKGDESYRELFSLLTQLFGPYPSLLEKVEQETWRETGISFVTSVTRLMERLLDYRDCMKGEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSPMNLMGTGRHSSSSLSSHASSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKGHYSLHFDAFHHPLGDTPPALPARTLRKSPLHPIPASPTSPQSGLDGSNSTLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 23380 - protein, 46 aa, Homo sapiens
  Payload ID: 4653
  Gene Symbol: DOCK4
  Gene Name: dedicator of cytokinesis 4
  ENSP ID: ENSP00000393486
MKMHSTESLLKKIERETWRESGVSLIATVTRLMERLLDYRTSIRLN

SEQ ID NO: 23381 - protein, 1999 aa, Homo sapiens
  Payload ID: 4653
  Gene Symbol: DOCK4
  Gene Name: dedicator of cytokinesis 4
  ENSP ID: ENSP00000397412
  MOD_RES (1)..(1): Any amino acid
XIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTRTGFLNRESSHGSTTLSTFSVCADTYGKVPMTSRHTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 23382 - protein, 131 aa, Homo sapiens
  Payload ID: 4653
  Gene Symbol: DOCK4
  Gene Name: dedicator of cytokinesis 4
  ENSP ID: ENSP00000403504
MFQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLL

SEQ ID NO: 23383 - protein, 1966 aa, Homo sapiens
  Payload ID: 4653
  Gene Symbol: DOCK4
  Gene Name: dedicator of cytokinesis 4
  Uniprot ID: Q8N1I0
  ENSP ID: ENSP00000404179
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 23384 - protein, 192 aa, Homo sapiens
  Payload ID: 4653
  Gene Symbol: DOCK4
  Gene Name: dedicator of cytokinesis 4
  ENSP ID: ENSP00000406298
MKMHSTESLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFR

SEQ ID NO: 23385 - protein, 188 aa, Homo sapiens
  Payload ID: 4653
  Gene Symbol: DOCK4
  Gene Name: dedicator of cytokinesis 4
  ENSP ID: ENSP00000406468
MKMHSTERIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDK

SEQ ID NO: 23386 - protein, 1975 aa, Homo sapiens
  Payload ID: 4653
  Gene Symbol: DOCK4
  Gene Name: dedicator of cytokinesis 4
  Uniprot ID: Q8N1I0
  ENSP ID: ENSP00000410746
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 23387 - protein, 1389 aa, Homo sapiens
  Payload ID: 4653
  Gene Symbol: DOCK4
  Gene Name: dedicator of cytokinesis 4
  ENSP ID: ENSP00000412834
  MOD_RES (1)..(1): Any amino acid
XGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 23388 - protein, 1094 aa, Homo sapiens
  Payload ID: 4653
  Gene Symbol: DOCK4
  Gene Name: dedicator of cytokinesis 4
  ENSP ID: ENSP00000440944
VIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALRQENRLNLGGGGCSEPRACHCTPAWATKRDCVSKKKEKKT

SEQ ID NO: 23389 - protein, 1870 aa, Homo sapiens
  Payload ID: 4654
  Gene Symbol: DOCK5
  Gene Name: dedicator of cytokinesis 5
  Uniprot ID: Q9H7D0
  ENSP ID: ENSP00000276440
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQWSDKPCVPHLLQKDSYYVYTQQELKEKLYQEIISYFDKGKMWEKAIKLSKELAETYESKVFDYEGLGNLLKKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFATMWIERTTYTTAYTFPGILKWFEVKQISTEEISPLENAIETMELTNERISNCVQQHAWDRSLSVHPLSMLLSGIVDPAVMGGFSNYEKAFFTEKYLQEHPEDQEKVELLKRLIALQMPLLTEGIRIHGEKLTEQLKPLHERLSSCFRELKEKVEKHYGVITLPPNLTERKQSRTGSIVLPYIMSSTLRRLSITSVTSSVVSTSSNSSDNAPSRPGSDGSILEPLLERRASSGARVEDLSLREENSENRISKFKRKDWSLSKSQVIAEKAPEPDLMSPTRKAQRPKSLQLMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 23390 - protein, 83 aa, Homo sapiens
  Payload ID: 4654
  Gene Symbol: DOCK5
  Gene Name: dedicator of cytokinesis 5
  ENSP ID: ENSP00000387036
MARWIPTKRQKYGVAIYNYNASQDVELSLQIGDTVHILEMYEGWYRGYTLQNKSKKAIGSRTPTIPKSMDAQVSDIKWHSICI

SEQ ID NO: 23391 - protein, 1090 aa, Homo sapiens
  Payload ID: 4654
  Gene Symbol: DOCK5
  Gene Name: dedicator of cytokinesis 5
  ENSP ID: ENSP00000414125
  MOD_RES (1)..(1): Any amino acid
XVNPAEPRFAGPVHLQYHPHLWPLCELQELCLQHRGRCRVVYGPLRPRPVHFYQDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQVNGSESLFQQGGVQCPFRLNSIHFMILMGKNFIPGISFYTSFFSSF

SEQ ID NO: 23392 - protein, 138 aa, Homo sapiens
  Payload ID: 4654
  Gene Symbol: DOCK5
  Gene Name: dedicator of cytokinesis 5
  ENSP ID: ENSP00000428479
  MOD_RES (1)..(1): Any amino acid
XMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYV

SEQ ID NO: 23393 - protein, 350 aa, Homo sapiens
  Payload ID: 4654
  Gene Symbol: DOCK5
  Gene Name: dedicator of cytokinesis 5
  Uniprot ID: Q9H7D0
  ENSP ID: ENSP00000429737
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQ

SEQ ID NO: 23394 - protein, 2047 aa, Homo sapiens
  Payload ID: 4655
  Gene Symbol: DOCK6
  Gene Name: dedicator of cytokinesis 6
  Uniprot ID: Q96HP0
  ENSP ID: ENSP00000294618
MAASERRAFAHKINRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 23395 - protein, 184 aa, Homo sapiens
  Payload ID: 4655
  Gene Symbol: DOCK6
  Gene Name: dedicator of cytokinesis 6
  ENSP ID: ENSP00000465767
LGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKGIDRSHSWVNSAYAPGGSKAVLRRAPPYCGADPRQAIDCNSSRASSYLEGSSSAPPATQLRPTVQKLLHEELALQWV

SEQ ID NO: 23396 - protein, 464 aa, Homo sapiens
  Payload ID: 4655
  Gene Symbol: DOCK6
  Gene Name: dedicator of cytokinesis 6
  ENSP ID: ENSP00000467191
  MOD_RES (1)..(1): Any amino acid
XYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKAIDCNSSRASSYLEGSSSAPPATQLRPTVQKLLHEELALQWVVSSSAVREAILQHAWFFFQLMVKSMALHLLLGQRLDTPRKLRFPGRFLDDITALVGSVGLEVITRVHK

SEQ ID NO: 23397 - protein, 148 aa, Homo sapiens
  Payload ID: 4655
  Gene Symbol: DOCK6
  Gene Name: dedicator of cytokinesis 6
  ENSP ID: ENSP00000467231
  MOD_RES (1)..(1): Any amino acid
XRHLPVGCVSFQNISSNVLEESAISDDILSPDEEGFCSGKHFTELGLVGLLEQAAGYFTMPQRVFGTYFRVGFYGAHFGDLDEQEFVYKEPSITKLAEISHRLEEFYTERFGDDVVEIIKDSNPVDKSKLDSQKAYIQITYVEPYFDT

SEQ ID NO: 23398 - protein, 98 aa, Homo sapiens
  Payload ID: 4655
  Gene Symbol: DOCK6
  Gene Name: dedicator of cytokinesis 6
  ENSP ID: ENSP00000468291
RKTLLSTDHAFPYIKTRIRVCHREEELLEQSKFPKGRPLSPQGPKLYLEEPAPGPQLSVLRGESALVPTGLWGDHTVLGAGPSAPVSPSVCTDASSLF

SEQ ID NO: 23399 - protein, 1336 aa, Homo sapiens
  Payload ID: 4655
  Gene Symbol: DOCK6
  Gene Name: dedicator of cytokinesis 6
  ENSP ID: ENSP00000468638
  MOD_RES (1)..(1): Any amino acid
XLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKGIDRSHSWVNSAYAPGGSKAVLRRAPPYCGADPRQLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 23400 - protein, 2131 aa, Homo sapiens
  Payload ID: 4656
  Gene Symbol: DOCK7
  Gene Name: dedicator of cytokinesis 7
  Uniprot ID: Q96N67
  ENSP ID: ENSP00000251157
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23401 - protein, 2109 aa, Homo sapiens
  Payload ID: 4656
  Gene Symbol: DOCK7
  Gene Name: dedicator of cytokinesis 7
  Uniprot ID: Q96N67
  ENSP ID: ENSP00000340742
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23402 - protein, 632 aa, Homo sapiens
  Payload ID: 4656
  Gene Symbol: DOCK7
  Gene Name: dedicator of cytokinesis 7
  Uniprot ID: Q96N67
  ENSP ID: ENSP00000384446
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPSPSCTHPIPTVRPLPLWCYHSIFSLLSWDFIT

SEQ ID NO: 23403 - protein, 2129 aa, Homo sapiens
  Payload ID: 4656
  Gene Symbol: DOCK7
  Gene Name: dedicator of cytokinesis 7
  ENSP ID: ENSP00000413583
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23404 - protein, 803 aa, Homo sapiens
  Payload ID: 4656
  Gene Symbol: DOCK7
  Gene Name: dedicator of cytokinesis 7
  ENSP ID: ENSP00000483062
MDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSP

SEQ ID NO: 23405 - protein, 46 aa, Homo sapiens
  Payload ID: 4656
  Gene Symbol: DOCK7
  Gene Name: dedicator of cytokinesis 7
  ENSP ID: ENSP00000488988
  MOD_RES (1)..(1): Any amino acid
XTTYRNLLYIYPQSLNFANRQGSARNITVKVQFMYGEDPSNAMPVS

SEQ ID NO: 23406 - protein, 255 aa, Homo sapiens
  Payload ID: 4656
  Gene Symbol: DOCK7
  Gene Name: dedicator of cytokinesis 7
  ENSP ID: ENSP00000489037
  MOD_RES (1)..(1): Any amino acid
XKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKLFHEELALQWVVCSGSVRESALQQAWFFFELMVKSMVHHLYFNDKLEA

SEQ ID NO: 23407 - protein, 2140 aa, Homo sapiens
  Payload ID: 4656
  Gene Symbol: DOCK7
  Gene Name: dedicator of cytokinesis 7
  ENSP ID: ENSP00000489124
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23408 - protein, 173 aa, Homo sapiens
  Payload ID: 4656
  Gene Symbol: DOCK7
  Gene Name: dedicator of cytokinesis 7
  ENSP ID: ENSP00000489164
  MOD_RES (1)..(1): Any amino acid
XECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQVLFCHVGILGRCLCINFFNFRKVVIVLYMYGRVIPRNLKTLRIKIIKATIRMR

SEQ ID NO: 23409 - protein, 2100 aa, Homo sapiens
  Payload ID: 4656
  Gene Symbol: DOCK7
  Gene Name: dedicator of cytokinesis 7
  ENSP ID: ENSP00000489284
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23410 - protein, 101 aa, Homo sapiens
  Payload ID: 4656
  Gene Symbol: DOCK7
  Gene Name: dedicator of cytokinesis 7
  ENSP ID: ENSP00000489412
FTESGLVGLLEQAAASFSMAGMYEAVNEVYKVLIPIHEANRDAKKLSTIHGKLQEAFSKIVHQFFYDLPFFTFYYTEYWLGADVWHLFSCWFLWNQVRGFG

SEQ ID NO: 23411 - protein, 248 aa, Homo sapiens
  Payload ID: 4656
  Gene Symbol: DOCK7
  Gene Name: dedicator of cytokinesis 7
  ENSP ID: ENSP00000489450
SSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQLFHEELALQWVVCSGSVRESAL

SEQ ID NO: 23412 - protein, 2098 aa, Homo sapiens
  Payload ID: 4656
  Gene Symbol: DOCK7
  Gene Name: dedicator of cytokinesis 7
  ENSP ID: ENSP00000489499
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 23413 - protein, 1566 aa, Homo sapiens
  Payload ID: 4657
  Gene Symbol: DOCK8
  Gene Name: dedicator of cytokinesis 8
  ENSP ID: ENSP00000371766
MCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 23414 - protein, 439 aa, Homo sapiens
  Payload ID: 4657
  Gene Symbol: DOCK8
  Gene Name: dedicator of cytokinesis 8
  ENSP ID: ENSP00000371768
MHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQVIKELFN

SEQ ID NO: 23415 - protein, 2099 aa, Homo sapiens
  Payload ID: 4657
  Gene Symbol: DOCK8
  Gene Name: dedicator of cytokinesis 8
  Uniprot ID: Q8NF50
  ENSP ID: ENSP00000394888
MATLPSAERRAFALKINRYSSAEIRKQFTLPPNLGQYHRQSISTSGFPSLQLPQFYDPVEPVDFEGLLMTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 23416 - protein, 2031 aa, Homo sapiens
  Payload ID: 4657
  Gene Symbol: DOCK8
  Gene Name: dedicator of cytokinesis 8
  Uniprot ID: Q8NF50
  ENSP ID: ENSP00000408464
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 23417 - protein, 66 aa, Homo sapiens
  Payload ID: 4657
  Gene Symbol: DOCK8
  Gene Name: dedicator of cytokinesis 8
  ENSP ID: ENSP00000417082
MTHLNSLDVQLAQELGDFTDDDLDVVFTPKECRTLQPSLPEEGVELDPHVRDCVQTYIREWLIVNR

SEQ ID NO: 23418 - protein, 502 aa, Homo sapiens
  Payload ID: 4657
  Gene Symbol: DOCK8
  Gene Name: dedicator of cytokinesis 8
  ENSP ID: ENSP00000417691
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYREVFQVSAVAH

SEQ ID NO: 23419 - protein, 107 aa, Homo sapiens
  Payload ID: 4657
  Gene Symbol: DOCK8
  Gene Name: dedicator of cytokinesis 8
  ENSP ID: ENSP00000418318
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAA

SEQ ID NO: 23420 - protein, 66 aa, Homo sapiens
  Payload ID: 4657
  Gene Symbol: DOCK8
  Gene Name: dedicator of cytokinesis 8
  ENSP ID: ENSP00000418587
MATLPSAERRAFALKINRYSSAEIRKQFTLPPNLGQYHRQSISTSGFPSLQLRRSFSMLSRLVLNS

SEQ ID NO: 23421 - protein, 1999 aa, Homo sapiens
  Payload ID: 4657
  Gene Symbol: DOCK8
  Gene Name: dedicator of cytokinesis 8
  Uniprot ID: Q8NF50
  ENSP ID: ENSP00000419438
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 23422 - protein, 50 aa, Homo sapiens
  Payload ID: 4657
  Gene Symbol: DOCK8
  Gene Name: dedicator of cytokinesis 8
  ENSP ID: ENSP00000436628
MATLPSAERRAFALKINSHALSPRLEYSGAISAHCNLCLPDSSDSPASAS

SEQ ID NO: 23423 - protein, 2102 aa, Homo sapiens
  Payload ID: 4658
  Gene Symbol: DOCK9
  Gene Name: dedicator of cytokinesis 9
  ENSP ID: ENSP00000341086
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQVSQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 23424 - protein, 424 aa, Homo sapiens
  Payload ID: 4658
  Gene Symbol: DOCK9
  Gene Name: dedicator of cytokinesis 9
  ENSP ID: ENSP00000344702
MMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQVSLLSILQTVLSPL

SEQ ID NO: 23425 - protein, 2068 aa, Homo sapiens
  Payload ID: 4658
  Gene Symbol: DOCK9
  Gene Name: dedicator of cytokinesis 9
  Uniprot ID: Q9BZ29
  ENSP ID: ENSP00000365643
MQADKCRTSSRSVKKELVIESPLQYKDAAQGEVEAESPGPVPAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQLG

SEQ ID NO: 23426 - protein, 669 aa, Homo sapiens
  Payload ID: 4658
  Gene Symbol: DOCK9
  Gene Name: dedicator of cytokinesis 9
  ENSP ID: ENSP00000383087
  MOD_RES (1)..(1): Any amino acid
XFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQICPLEEKTSVLPNSLHIFNAISGTPTSTMVHGMTSSSSVV

SEQ ID NO: 23427 - protein, 390 aa, Homo sapiens
  Payload ID: 4658
  Gene Symbol: DOCK9
  Gene Name: dedicator of cytokinesis 9
  ENSP ID: ENSP00000388193
  MOD_RES (1)..(1): Any amino acid
XQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQ

SEQ ID NO: 23428 - protein, 116 aa, Homo sapiens
  Payload ID: 4658
  Gene Symbol: DOCK9
  Gene Name: dedicator of cytokinesis 9
  ENSP ID: ENSP00000396897
  MOD_RES (1)..(1): Any amino acid
XSELMDFFTISEVCLHQFQYMGKRYIARNQEGLGPIVHDRKSQTLPVSRNRTGMMHARLQQLGSLDNSLTFNHSYGHSDADVLHQSLLEANIATEVCLTALDTLSLFTLAFKNQLL

SEQ ID NO: 23429 - protein, 2079 aa, Homo sapiens
  Payload ID: 4658
  Gene Symbol: DOCK9
  Gene Name: dedicator of cytokinesis 9
  ENSP ID: ENSP00000401958
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQVRRSAPWRRRRASYRIPFTSSTPSVGLQQAQWFTG

SEQ ID NO: 23430 - protein, 250 aa, Homo sapiens
  Payload ID: 4658
  Gene Symbol: DOCK9
  Gene Name: dedicator of cytokinesis 9
  ENSP ID: ENSP00000403528
ADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIASVRKISSVLGISVDNGYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRN

SEQ ID NO: 23431 - protein, 2101 aa, Homo sapiens [sequence omitted]

SEQ ID NO: 23432 - protein, 203 aa, Homo sapiens
  Payload ID: 4658
  Gene Symbol: DOCK9
  Gene Name: dedicator of cytokinesis 9
  ENSP ID: ENSP00000407610
RKTWLDSMARIHVKNGDLSEAAMCYVHVTALVAEYLTRKGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQGFFEDEDGKEYIYKEPKLTPLSEISQRLLKLYSDKFGSENVKMIQDSGK

SEQ ID NO: 23433 - protein, 1254 aa, Homo sapiens
  Payload ID: 4658
  Gene Symbol: DOCK9
  Gene Name: dedicator of cytokinesis 9
  ENSP ID: ENSP00000413781
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIGNAPCSCGLLSTITLKVSWSQ

SEQ ID NO: 23434 - protein, 69 aa, Homo sapiens
  Payload ID: 4658
  Gene Symbol: DOCK9
  Gene Name: dedicator of cytokinesis 9
  ENSP ID: ENSP00000486269
MSQPPLLPASAETRKFTRALSKPGTAAELRQSVSEVVRGSVLLAAGEPLPVDPFSLESVMCPGSASSSC

SEQ ID NO: 23435 - protein, 705 aa, Homo sapiens
  Payload ID: 4658
  Gene Symbol: DOCK9
  Gene Name: dedicator of cytokinesis 9
  ENSP ID: ENSP00000486606
MQADKCRTSSRSVKKELVIESPLQYKDAAQGEVEAESPGPVPAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKTWWASFHKKRLCCSFTPSPKPRIL

SEQ ID NO: 23436 - protein, 1253 aa, Homo sapiens
  Payload ID: 4658
  Gene Symbol: DOCK9
  Gene Name: dedicator of cytokinesis 9
  Uniprot ID: Q9BZ29
  ENSP ID: ENSP00000487551
MQADKCRTSSRSVKKELVIESPLQYKDAAQGEVEAESPGPVPAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIGNAPCSCGLLSTITLKVSWSQ

SEQ ID NO: 23437 - protein, 550 aa, Homo sapiens
  Payload ID: 4659
  Gene Symbol: DET1
  Gene Name: de-etiolated homolog 1 (Arabidopsis)
  Uniprot ID: Q7L5Y6
  ENSP ID: ENSP00000268148
MDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 23438 - protein, 561 aa, Homo sapiens
  Payload ID: 4659
  Gene Symbol: DET1
  Gene Name: de-etiolated homolog 1 (Arabidopsis)
  Uniprot ID: Q7L5Y6
  ENSP ID: ENSP00000408994
MVGQILKRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 23439 - protein, 67 aa, Homo sapiens
  Payload ID: 4659
  Gene Symbol: DET1
  Gene Name: de-etiolated homolog 1 (Arabidopsis)
  ENSP ID: ENSP00000452613
MDHHVSTIKPRRIQNQNVIHRLERRRISSGKTRHLLKSMSTRAARQQRTYCRDTKEKSCPMAMTSGQ

SEQ ID NO: 23440 - protein, 67 aa, Homo sapiens; identical to SEQ ID NO: 23439
  Payload ID: 4659
  Gene Symbol: DET1
  Gene Name: de-etiolated homolog 1 (Arabidopsis)
  ENSP ID: ENSP00000452856

SEQ ID NO: 23441 - protein, 94 aa, Homo sapiens
  Payload ID: 4659
  Gene Symbol: DET1
  Gene Name: de-etiolated homolog 1 (Arabidopsis)
  ENSP ID: ENSP00000453900
MDHHVSTIKPRRIQNQNVIHRLERRRISSGKADQTSLEIYEYQGCQAAEDLLQGYEGEILSNGNDQRSVNIRGRLFERFFVLLHITNVAANGDS

SEQ ID NO: 23442 - protein, 561 aa, Homo sapiens; identical to SEQ ID NO: 23438
  Payload ID: 4659
  Gene Symbol: DET1
  Gene Name: de-etiolated homolog 1 (Arabidopsis)
  Uniprot ID: Q7L5Y6
  ENSP ID: ENSP00000456340

SEQ ID NO: 23443 - protein, 631 aa, Homo sapiens
  Payload ID: 4660
  Gene Symbol: DEF6
  Gene Name: DEF6 guanine nucleotide exchange factor
  Uniprot ID: Q9H4E7
  ENSP ID: ENSP00000319831
MALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTANRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 23444 - protein, 129 aa, Homo sapiens
  Payload ID: 4660
  Gene Symbol: DEF6
  Gene Name: DEF6 guanine nucleotide exchange factor
  ENSP ID: ENSP00000415357
  MOD_RES (1)..(1): Any amino acid
XRDDDDGPVSSQGYMPYLNKYILDKDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQ

SEQ ID NO: 23445 - protein, 113 aa, Homo sapiens
  Payload ID: 4661
  Gene Symbol: DAD1
  Gene Name: defender against cell death 1
  Uniprot ID: P61803
  ENSP ID: ENSP00000250498
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 23446 - protein, 78 aa, Homo sapiens
  Payload ID: 4661
  Gene Symbol: DAD1
  Gene Name: defender against cell death 1
  ENSP ID: ENSP00000440242
MSASVVSVISRFLEEYLSSTPQRLKLLDAYLLYILLTGALQFGYCLLVGTFPFNSFLSGFISCVGSFILAGSLFEFPG

SEQ ID NO: 23447 - protein, 85 aa, Homo sapiens
  Payload ID: 4661
  Gene Symbol: DAD1
  Gene Name: defender against cell death 1
  ENSP ID: ENSP00000440821
MSASVVSVISRFLEEYLSSTPQRLKLLDAYLLYILLTGALQFVCLRIQINPQNKADFQGISPERAFADFLFASTILHLVVMNFVG

SEQ ID NO: 23448 - protein, 65 aa, Homo sapiens
  Payload ID: 4661
  Gene Symbol: DAD1
  Gene Name: defender against cell death 1
  ENSP ID: ENSP00000442074
MSASVVSVISRFLEEYLSSTPQRLKLLDAYLLYILLTGALHLPENTDQPTEQSGFPRHLPRASLC

SEQ ID NO: 23449 - protein, 94 aa, Homo sapiens
  Payload ID: 4662
  Gene Symbol: DEFA1
  Gene Name: defensin, alpha 1
  Uniprot ID: P59665
  ENSP ID: ENSP00000372126
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 23450 - protein, 94 aa, Homo sapiens; identical to SEQ ID NO: 23449
  Payload ID: 4662
  Gene Symbol: DEFA1
  Gene Name: defensin, alpha 1
  Uniprot ID: P59665
  ENSP ID: ENSP00000372139

SEQ ID NO: 23451 - protein, 94 aa, Homo sapiens; identical to SEQ ID NO: 23449
  Payload ID: 4663
  Gene Symbol: DEFA1B
  Gene Name: defensin, alpha 1B
  Uniprot ID: P59665
  ENSP ID: ENSP00000372136

SEQ ID NO: 23452 - protein, 94 aa, Homo sapiens; identical to SEQ ID NO: 23449
  Payload ID: 4663
  Gene Symbol: DEFA1B
  Gene Name: defensin, alpha 1B
  Uniprot ID: P59665
  ENSP ID: ENSP00000443526

SEQ ID NO: 23453 - protein, 94 aa, Homo sapiens
  Payload ID: 4664
  Gene Symbol: DEFA3
  Gene Name: defensin, alpha 3, neutrophil-specific
  Uniprot ID: P59666
  ENSP ID: ENSP00000328359
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 23454 - protein, 94 aa, Homo sapiens; identical to SEQ ID NO: 23449
  Payload ID: 4664
  Gene Symbol: DEFA3
  Gene Name: defensin, alpha 3, neutrophil-specific
  ENSP ID: ENSP00000484218

SEQ ID NO: 23455 - protein, 97 aa, Homo sapiens
  Payload ID: 4665
  Gene Symbol: DEFA4
  Gene Name: defensin, alpha 4, corticostatin
  Uniprot ID: P12838
  ENSP ID: ENSP00000297435
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 23456 - protein, 94 aa, Homo sapiens
  Payload ID: 4666
  Gene Symbol: DEFA5
  Gene Name: defensin, alpha 5, Paneth cell-specific
  Uniprot ID: Q01523
  ENSP ID: ENSP00000329890
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 23457 - protein, 100 aa, Homo sapiens
  Payload ID: 4667
  Gene Symbol: DEFA6
  Gene Name: defensin, alpha 6, Paneth cell-specific
  Uniprot ID: Q01524
  ENSP ID: ENSP00000297436
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 23458 - protein, 68 aa, Homo sapiens
  Payload ID: 4668
  Gene Symbol: DEFB1
  Gene Name: defensin, beta 1
  Uniprot ID: P60022
  ENSP ID: ENSP00000297439
MRTSYLLLFTLCLLLSEMASGGNFLTGLGHRSDHYNCVSSGGQCLYSACPIFTKIQGTCYRGKAKCCK

SEQ ID NO: 23459 - protein, 67 aa, Homo sapiens
  Payload ID: 4669
  Gene Symbol: DEFB103A
  Gene Name: defensin, beta 103A
  Uniprot ID: P81534
  ENSP ID: ENSP00000320951
MRIHYLLFALLFLFLVPVPGHGGIINTLQKYYCRVRGGRCAVLSCLPKEEQIGKCSTRGRKCCRRKK

SEQ ID NO: 23460 - protein, 67 aa, Homo sapiens; identical to SEQ ID NO: 23459
  Payload ID: 4670
  Gene Symbol: DEFB103B
  Gene Name: defensin, beta 103B
  Uniprot ID: P81534
  ENSP ID: ENSP00000324633

SEQ ID NO: 23461 - protein, 67 aa, Homo sapiens; identical to SEQ ID NO: 23459
  Payload ID: 4670
  Gene Symbol: DEFB103B
  Gene Name: defensin, beta 103B
  Uniprot ID: P81534
  ENSP ID: ENSP00000480773

SEQ ID NO: 23462 - protein, 72 aa, Homo sapiens
  Payload ID: 4671
  Gene Symbol: DEFB104A
  Gene Name: defensin, beta 104A
  Uniprot ID: Q8WTQ1
  ENSP ID: ENSP00000320813
MQRLVLLLAISLLLYQDLPVRSEFELDRICGYGTARCRKKCRSQEYRIGRCPNTYACCLRKWDESLLNRTKP

SEQ ID NO: 23463 - protein, 72 aa, Homo sapiens; identical to SEQ ID NO: 23462
  Payload ID: 4672
  Gene Symbol: DEFB104B
  Gene Name: defensin, beta 104B
  Uniprot ID: Q8WTQ1
  ENSP ID: ENSP00000322191

SEQ ID NO: 23464 - protein, 72 aa, Homo sapiens; identical to SEQ ID NO: 23462
  Payload ID: 4672
  Gene Symbol: DEFB104B
  Gene Name: defensin, beta 104B
  Uniprot ID: Q8WTQ1
  ENSP ID: ENSP00000481976

SEQ ID NO: 23465 - protein, 78 aa, Homo sapiens
  Payload ID: 4673
  Gene Symbol: DEFB105A
  Gene Name: defensin, beta 105A
  Uniprot ID: Q8NG35
  ENSP ID: ENSP00000334330
MALIRKTFYFLFAMFFILVQLPSGCQAGLDFSQPFPSGEFAVCESCKLGRGKCRKECLENEKPDGNCRLNFLCCRQRI

SEQ ID NO: 23466 - protein, 78 aa, Homo sapiens; identical to SEQ ID NO: 23465
  Payload ID: 4674
  Gene Symbol: DEFB105B
  Gene Name: defensin, beta 105B
  Uniprot ID: Q8NG35
  ENSP ID: ENSP00000335281

SEQ ID NO: 23467 - protein, 78 aa, Homo sapiens; identical to SEQ ID NO: 23465
  Payload ID: 4674
  Gene Symbol: DEFB105B
  Gene Name: defensin, beta 105B
  Uniprot ID: Q8NG35
  ENSP ID: ENSP00000482176

SEQ ID NO: 23468 - protein, 65 aa, Homo sapiens
  Payload ID: 4675
  Gene Symbol: DEFB106A
  Gene Name: defensin, beta 106A
  Uniprot ID: Q8N104
  ENSP ID: ENSP00000335307
MRTFLFLFAVLFFLTPAKNAFFDEKCNKLKGTCKNNCGKNEELIALCQKSLKCCRTIQPCGSIID

SEQ ID NO: 23469 - protein, 65 aa, Homo sapiens; identical to SEQ ID NO: 23468
  Payload ID: 4676
  Gene Symbol: DEFB106B
  Gene Name: defensin, beta 106B
  Uniprot ID: Q8N104
  ENSP ID: ENSP00000334364

SEQ ID NO: 23470 - protein, 65 aa, Homo sapiens; identical to SEQ ID NO: 23468
  Payload ID: 4676
  Gene Symbol: DEFB106B
  Gene Name: defensin, beta 106B
  Uniprot ID: Q8N104
  ENSP ID: ENSP00000477883

SEQ ID NO: 23471 - protein, 70 aa, Homo sapiens
  Payload ID: 4677
  Gene Symbol: DEFB107A
  Gene Name: defensin, beta 107A
  Uniprot ID: Q8IZN7
  ENSP ID: ENSP00000334681
MPGAMKIFVFILAALILLAQIFQARTAIHRALISKRMEGHCEAECLTFEVKIGGCRAELAPFCCKNRKKH

SEQ ID NO: 23472 - protein, 70 aa, Homo sapiens; identical to SEQ ID NO: 23471
  Payload ID: 4678
  Gene Symbol: DEFB107B
  Gene Name: defensin, beta 107B
  Uniprot ID: Q8IZN7
  ENSP ID: ENSP00000347810

SEQ ID NO: 23473 - protein, 70 aa, Homo sapiens; identical to SEQ ID NO: 23471
  Payload ID: 4678
  Gene Symbol: DEFB107B
  Gene Name: defensin, beta 107B
  Uniprot ID: Q8IZN7
  ENSP ID: ENSP00000478422

SEQ ID NO: 23474 - protein, 73 aa, Homo sapiens
  Payload ID: 4679
  Gene Symbol: DEFB108B
  Gene Name: defensin, beta 108B
  Uniprot ID: Q8NET1
  ENSP ID: ENSP00000333234
MRIAVLLFAIFFFMSQVLPARGKFKEICERPNGSCRDFCLETEIHVGRCLNSQPCCLPLGHQPRIESTTPKKD

SEQ ID NO: 23475 - protein, 67 aa, Homo sapiens
  Payload ID: 4680
  Gene Symbol: DEFB110
  Gene Name: defensin, beta 110
  Uniprot ID: Q30KQ9
  ENSP ID: ENSP00000360190
MKIQLFFFILHFWVTILPAKKKYPEYGSLDLRRECRIGNGQCKNQCHENEIRIAYCIRPGTHCCLQQ

SEQ ID NO: 23476 - protein, 62 aa, Homo sapiens
  Payload ID: 4680
  Gene Symbol: DEFB110
  Gene Name: defensin, beta 110
  Uniprot ID: Q30KQ9
  ENSP ID: ENSP00000377270
MKIQLFFFILHFWVTILPARSNFEPKYRFERCEKVRGICKTFCDDVEYDYGYCIKWRSQCCV

SEQ ID NO: 23477 - protein, 113 aa, Homo sapiens
  Payload ID: 4681
  Gene Symbol: DEFB112
  Gene Name: defensin, beta 112
  Uniprot ID: Q30KQ8
  ENSP ID: ENSP00000319126
MKLLTTICRLKLEKMYSKTNTSSTIFEKARHGTEKISTARSEGHHITFSRWKSCTAIGGRCKNQCDDSEFRISYCARPTTHCCVTECDPTDPNNWIPKDSVGTQEWYPKDSRH

SEQ ID NO: 23478 - protein, 82 aa, Homo sapiens
  Payload ID: 4682
  Gene Symbol: DEFB113
  Gene Name: defensin, beta 113
  Uniprot ID: Q30KQ7
  ENSP ID: ENSP00000381703
MKILCIFLTFVFTVSCGPSVPQKKTREVAERKRECQLVRGACKPECNSWEYVYYYCNVNPCCAVWEYQKPIINKITSKLHQK

SEQ ID NO: 23479 - protein, 69 aa, Homo sapiens
  Payload ID: 4683
  Gene Symbol: DEFB114
  Gene Name: defensin, beta 114
  Uniprot ID: Q30KQ6
  ENSP ID: ENSP00000312702
MRIFYYLHFLCYVTFILPATCTLVNADRCTKRYGRCKRDCLESEKQIDICSLPRKICCTEKLYEEDDMF

SEQ ID NO: 23480 - protein, 88 aa, Homo sapiens
  Payload ID: 4684
  Gene Symbol: DEFB115
  Gene Name: defensin, beta 115
  Uniprot ID: Q30KQ5
  ENSP ID: ENSP00000383398
MLPDHFSPLSGDIKLSVLALVVLVVLAQTAPDGWIRRCYYGTGRCRKSCKEIERKKEKCGEKHICCVPKEKDKLSHIHDQKETSELYI

SEQ ID NO: 23481 - protein, 102 aa, Homo sapiens
  Payload ID: 4685
  Gene Symbol: DEFB116
  Gene Name: defensin, beta 116
  Uniprot ID: Q30KQ4
  ENSP ID: ENSP00000383396
MSVMKPCLMTIAILMILAQKTPGGLFRSHNGKSREPWNPCELYQGMCRNACREYEIQYLTCPNDQKCCLKLSVKITSSKNVKEDYDSNSNLSVTNSSSYSHI

SEQ ID NO: 23482 - protein, 123 aa, Homo sapiens
  Payload ID: 4686
  Gene Symbol: DEFB118
  Gene Name: defensin, beta 118
  Uniprot ID: Q96PH6
  ENSP ID: ENSP00000253381
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 23483 - protein, 43 aa, Homo sapiens
  Payload ID: 4687
  Gene Symbol: DEFB119
  Gene Name: defensin, beta 119
  Uniprot ID: Q8N690
  ENSP ID: ENSP00000345768
MKLLYLFLAILLAIEEPVISALVRTVGCCLDTARQTPHPSMHG

SEQ ID NO: 23484 - protein, 88 aa, Homo sapiens
  Payload ID: 4687
  Gene Symbol: DEFB119
  Gene Name: defensin, beta 119
  Uniprot ID: Q8N690
  ENSP ID: ENSP00000365492
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 23485 - protein, 84 aa, Homo sapiens
  Payload ID: 4687
  Gene Symbol: DEFB119
  Gene Name: defensin, beta 119
  Uniprot ID: Q8N690
  ENSP ID: ENSP00000365499
MKLLYLFLAILLAIEEPVISGKRHILRCMGNSGICRASCKKNEQPYLYCRNCQSCCLQSYMRISISGKEENTDWSYEKQWPRLP

SEQ ID NO: 23486 - protein, 76 aa, Homo sapiens
  Payload ID: 4688
  Gene Symbol: DEFB121
  Gene Name: defensin, beta 121
  Uniprot ID: Q5J5C9
  ENSP ID: ENSP00000417128
MKLLLLLLTVTLLLAQVTPVMKCWGKSGRCRTTCKESEVYYILCKTEAKCCVDPKYVPVKPKLTDTNTSLESTSAV

SEQ ID NO: 23487 - protein, 67 aa, Homo sapiens
  Payload ID: 4689
  Gene Symbol: DEFB123
  Gene Name: defensin, beta 123
  Uniprot ID: Q8N688
  ENSP ID: ENSP00000365486
MKLLLLTLTVLLLLSQLTPGGTQRCWNLYGKCRYRCSKKERVYVYCINNKMCCVKPKYQPKERWWPF

SEQ ID NO: 23488 - protein, 71 aa, Homo sapiens
  Payload ID: 4690
  Gene Symbol: DEFB124
  Gene Name: defensin, beta 124
  Uniprot ID: Q8NES8
  ENSP ID: ENSP00000326309
MTQLLLFLVALLVLGHVPSGRSEFKRCWKGQGACQTYCTRQETYMHLCPDASLCCLSYALKPPPVPKHEYE

SEQ ID NO: 23489 - protein, 156 aa, Homo sapiens
  Payload ID: 4691
  Gene Symbol: DEFB125
  Gene Name: defensin, beta 125
  Uniprot ID: Q8N687
  ENSP ID: ENSP00000371847
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 23490 - protein, 111 aa, Homo sapiens
  Payload ID: 4692
  Gene Symbol: DEFB126
  Gene Name: defensin, beta 126
  Uniprot ID: Q9BYW3
  ENSP ID: ENSP00000371835
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 23491 - protein, 99 aa, Homo sapiens
  Payload ID: 4693
  Gene Symbol: DEFB127
  Gene Name: defensin, beta 127
  Uniprot ID: Q9H1M4
  ENSP ID: ENSP00000371825
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 23492 - protein, 93 aa, Homo sapiens
  Payload ID: 4694
  Gene Symbol: DEFB128
  Gene Name: defensin, beta 128
  Uniprot ID: Q7Z7B8
  ENSP ID: ENSP00000335382
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 23493 - protein, 183 aa, Homo sapiens
  Payload ID: 4695
  Gene Symbol: DEFB129
  Gene Name: defensin, beta 129
  Uniprot ID: Q9H1M3
  ENSP ID: ENSP00000246105
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 23494 - protein, 79 aa, Homo sapiens
  Payload ID: 4696
  Gene Symbol: DEFB130
  Gene Name: defensin, beta 130
  Uniprot ID: Q30KQ2
  ENSP ID: ENSP00000382951
MKLHSLISVLLLFVTLIPKGKTGVIPGQKQCIALKGVCRDKLCSTLDDTIGICNEGKKCCRRWWILEPYPTPVPKGKSP

SEQ ID NO: 23495 - protein, 70 aa, Homo sapiens
  Payload ID: 4697
  Gene Symbol: DEFB131
  Gene Name: defensin, beta 131
  Uniprot ID: P59861
  ENSP ID: ENSP00000335538
MRVLFFVFGVLSLMFTVPPARSFISNDECPSEYYHCRLKCNADEHAIRYCADFSICCKLKIIEIDGQKKW

SEQ ID NO: 23496 - protein, 95 aa, Homo sapiens
  Payload ID: 4698
  Gene Symbol: DEFB132
  Gene Name: defensin, beta 132
  Uniprot ID: Q7Z7B7
  ENSP ID: ENSP00000371813
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 23497 - protein, 61 aa, Homo sapiens
  Payload ID: 4699
  Gene Symbol: DEFB133
  Gene Name: defensin, beta 133
  Uniprot ID: Q30KQ1
  ENSP ID: ENSP00000485031
MKIHVFLFVLFFFLVPIATRVKCAVKDTYSCFIMRGKCRHECHDFEKPIGFCTKLNANCYM

SEQ ID NO: 23498 - protein, 66 aa, Homo sapiens
  Payload ID: 4700
  Gene Symbol: DEFB134
  Gene Name: defensin, beta 134
  Uniprot ID: Q4QY38
  ENSP ID: ENSP00000371640
MKPLLVVFVFLFLWDPVLAGINSLSSEMHKKCYKNGICRLECYESEMLVAYCMFQLECCVKGNPAP

SEQ ID NO: 23499 - protein, 66 aa, Homo sapiens; identical to SEQ ID NO: 23498
  Payload ID: 4700
  Gene Symbol: DEFB134
  Gene Name: defensin, beta 134
  Uniprot ID: Q4QY38
  ENSP ID: ENSP00000435010

SEQ ID NO: 23500 - protein, 77 aa, Homo sapiens
  Payload ID: 4701
  Gene Symbol: DEFB135
  Gene Name: defensin, beta 135
  Uniprot ID: Q30KP9
  ENSP ID: ENSP00000371643
MATRSVLLALVVLNLLFYVPPGRSGPNVYIQKIFASCWRLQGTCRPKCLKNEQYRILCDTIHLCCVNPKYLPILTGK

SEQ ID NO: 23501 - protein, 78 aa, Homo sapiens
  Payload ID: 4702
  Gene Symbol: DEFB136
  Gene Name: defensin, beta 136
  Uniprot ID: Q30KP8
  ENSP ID: ENSP00000371644
MNLCLSALLFFLVILLPSGKGMFGNDGVKVRTCTSQKAVCFFGCPPGYRWIAFCHNILSCCKNMTRFQPPQAKDPWVH

SEQ ID NO: 23502 - protein, 64 aa, Homo sapiens
  Payload ID: 4703
  Gene Symbol: DEFB4A
  Gene Name: defensin, beta 4A
  Uniprot ID: O15263
  ENSP ID: ENSP00000303532
MRVLYLLFSFLFIFLMPLPGVFGGIGDPVTCLKSGAICHPVFCPRRYKQIGTCGLPGTKCCKKP

SEQ ID NO: 23503 - protein, 64 aa, Homo sapiens; identical to SEQ ID NO: 23502
  Payload ID: 4704
  Gene Symbol: DEFB4B
  Gene Name: defensin, beta 4B
  Uniprot ID: O15263
  ENSP ID: ENSP00000424598

SEQ ID NO: 23504 - protein, 64 aa, Homo sapiens; identical to SEQ ID NO: 23502
  Payload ID: 4704
  Gene Symbol: DEFB4B
  Gene Name: defensin, beta 4B
  Uniprot ID: O15263
  ENSP ID: ENSP00000479138

SEQ ID NO: 23505 - protein, 333 aa, Homo sapiens
  Payload ID: 4705
  Gene Symbol: DHDDS
  Gene Name: dehydrodolichyl diphosphate synthase subunit
  Uniprot ID: Q86SQ9
  ENSP ID: ENSP00000236342
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 23506 - protein, 334 aa, Homo sapiens
  Payload ID: 4705
  Gene Symbol: DHDDS
  Gene Name: dehydrodolichyl diphosphate synthase subunit
  Uniprot ID: Q86SQ9
  ENSP ID: ENSP00000353104
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQQKARDMYAEERKRQQLERDQATVTEQLLREGLQASGDAQLRRTRLHKLSARREERVQGFLQALELKRADWLARLGTASA

SEQ ID NO: 23507 - protein, 209 aa, Homo sapiens
  Payload ID: 4705
  Gene Symbol: DHDDS
  Gene Name: dehydrodolichyl diphosphate synthase subunit
  ENSP ID: ENSP00000363300
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPRYPELFCMVIVKENRPGPAWQLTPVILAH

SEQ ID NO: 23508 - protein, 162 aa, Homo sapiens
  Payload ID: 4705
  Gene Symbol: DHDDS
  Gene Name: dehydrodolichyl diphosphate synthase subunit
  ENSP ID: ENSP00000393961
  MOD_RES (1)..(1): Any amino acid
XHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQHPGSLLTKAWKKPFQQDGELYGNCSSPKSS

SEQ ID NO: 23509 - protein, 216 aa, Homo sapiens
  Payload ID: 4705
  Gene Symbol: DHDDS
  Gene Name: dehydrodolichyl diphosphate synthase subunit
  ENSP ID: ENSP00000397584
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQ

SEQ ID NO: 23510 - protein, 198 aa, Homo sapiens
  Payload ID: 4705
  Gene Symbol: DHDDS
  Gene Name: dehydrodolichyl diphosphate synthase subunit
  ENSP ID: ENSP00000399177
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSRDRFHHIGQASLELLTS

SEQ ID NO: 23511 - protein, 169 aa, Homo sapiens
  Payload ID: 4705
  Gene Symbol: DHDDS
  Gene Name: dehydrodolichyl diphosphate synthase subunit
  ENSP ID: ENSP00000399781
LARQKFSRLMEEKEKLQKHGVCIRVLGDLHLLPLDLQELIAQAVQATKNYNNDISESLLDKCLYTNRSPHPDILIRTSGEVRLSDFLLWQQKARDMYAEERKRQQLERDQATVTEQLLREGLQASGDAQLRRTRLHKLSARREERVQGFLQALELKRADWLARLGTASA

SEQ ID NO: 23512 - protein, 73 aa, Homo sapiens
  Payload ID: 4705
  Gene Symbol: DHDDS
  Gene Name: dehydrodolichyl diphosphate synthase subunit
  ENSP ID: ENSP00000403529
MSWIKEGELSLWERFCANIIKAGPMPKHIAFIMDGNRRYAKKCQVERQEGHSQGFNKLAELLAFSPLRLCGGV

SEQ ID NO: 23513 - protein, 173 aa, Homo sapiens
  Payload ID: 4705
  Gene Symbol: DHDDS
  Gene Name: dehydrodolichyl diphosphate synthase subunit
  ENSP ID: ENSP00000405604
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGV

SEQ ID NO: 23514 - protein, 71 aa, Homo sapiens
  Payload ID: 4705
  Gene Symbol: DHDDS
  Gene Name: dehydrodolichyl diphosphate synthase subunit
  ENSP ID: ENSP00000431407
MSWIKEGELSLWERFCANIIKAGPMPKHIAFIMDGNRRYAKKCQVERQEGHSQGFNKLAETLRWCLNLGIL

SEQ ID NO: 23515 - protein, 60 aa, Homo sapiens
  Payload ID: 4705
  Gene Symbol: DHDDS
  Gene Name: dehydrodolichyl diphosphate synthase subunit
  ENSP ID: ENSP00000433491
MSWIKEGELSLWERFCANIIKAGPMPKHIAFIMDGNRRYAKKCQVERQEGHSQGFNKLAE

SEQ ID NO: 23516 - protein, 85 aa, Homo sapiens
  Payload ID: 4705
  Gene Symbol: DHDDS
  Gene Name: dehydrodolichyl diphosphate synthase subunit
  ENSP ID: ENSP00000433976
MSWIKEGELSLWERFCANIIKAGPMPKHIAFIMDGNRRYAKKCQVERQEGHSQGFNKLAETLRWCLNLGILEVTVYAFSIENFKR

SEQ ID NO: 23517 - protein, 122 aa, Homo sapiens
  Payload ID: 4705
  Gene Symbol: DHDDS
  Gene Name: dehydrodolichyl diphosphate synthase subunit
  ENSP ID: ENSP00000434185
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLG

SEQ ID NO: 23518 - protein, 294 aa, Homo sapiens
  Payload ID: 4705
  Gene Symbol: DHDDS
  Gene Name: dehydrodolichyl diphosphate synthase subunit
  Uniprot ID: Q86SQ9
  ENSP ID: ENSP00000434219
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 23519 - protein, 299 aa, Homo sapiens
  Payload ID: 4705
  Gene Symbol: DHDDS
  Gene Name: dehydrodolichyl diphosphate synthase subunit
  Uniprot ID: Q86SQ9
  ENSP ID: ENSP00000434984
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNNDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 23520 - protein, 165 aa, Homo sapiens
  Payload ID: 4705
  Gene Symbol: DHDDS
  Gene Name: dehydrodolichyl diphosphate synthase subunit
  ENSP ID: ENSP00000436119
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNA

SEQ ID NO: 23521 - protein, 130 aa, Homo sapiens
  Payload ID: 4705
  Gene Symbol: DHDDS
  Gene Name: dehydrodolichyl diphosphate synthase subunit
  ENSP ID: ENSP00000436764
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLD

SEQ ID NO: 23522 - protein, 919 aa, Homo sapiens
  Payload ID: 4706
  Gene Symbol: DHTKD1
  Gene Name: dehydrogenase E1 and transketolase domain containing 1
  Uniprot ID: Q96HY7
  ENSP ID: ENSP00000263035
MASATAAAARRGLGRALPLFWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAIVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKLRLVGRPPLPVPAVGIGTVHLHQHEDILAKTFA

SEQ ID NO: 23523 - protein, 307 aa, Homo sapiens
  Payload ID: 4706
  Gene Symbol: DHTKD1
  Gene Name: dehydrogenase E1 and transketolase domain containing 1
  ENSP ID: ENSP00000388163
MASATAAAARRGLGRALPLFWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQLMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTT

SEQ ID NO: 23524 - protein, 214 aa, Homo sapiens
  Payload ID: 4706
  Gene Symbol: DHTKD1
  Gene Name: dehydrogenase E1 and transketolase domain containing 1
  ENSP ID: ENSP00000398482
  MOD_RES (1)..(1): Any amino acid
XKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAIVVCQETDDTYIPLNHMDPNQKGFLEERPSGSYKAASSSSFHMATMGLGQTTHPVE

SEQ ID NO: 23525 - protein, 160 aa, Homo sapiens
  Payload ID: 4706
  Gene Symbol: DHTKD1
  Gene Name: dehydrogenase E1 and transketolase domain containing 1
  ENSP ID: ENSP00000400625
GRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRYNYKPLCDM

SEQ ID NO: 23526 - protein, 313 aa, Homo sapiens
  Payload ID: 4707
  Gene Symbol: DHRS1
  Gene Name: dehydrogenase/reductase (SDR family) member 1
  Uniprot ID: Q96LJ7
  ENSP ID: ENSP00000288111
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYMFNVPYGVGKAACDKLAADCAHELRRHGVSCVSLWPGIVQTELLKEHMAKEEVLQDPVLKQFKSAFSSAETTELSGKCVVALATDPNILSLSGKVLPSCDLARRYGLRDVDGRPVQDYLSLSSVLSHVSGLGWLASYLPSFLRVPKWIIALYTSKF

SEQ ID NO: 23527 - protein, 313 aa, Homo sapiens; identical to SEQ ID NO: 23526
  Payload ID: 4707
  Gene Symbol: DHRS1
  Gene Name: dehydrogenase/reductase (SDR family) member 1
  Uniprot ID: Q96LJ7
  ENSP ID: ENSP00000380027

SEQ ID NO: 23528 - protein, 147 aa, Homo sapiens
  Payload ID: 4707
  Gene Symbol: DHRS1
  Gene Name: dehydrogenase/reductase (SDR family) member 1
  ENSP ID: ENSP00000453949
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRKPAVYVQCPLWCGQSCGEDPVA

SEQ ID NO: 23529 - protein, 181 aa, Homo sapiens
  Payload ID: 4708
  Gene Symbol: DHRS11
  Gene Name: dehydrogenase/reductase (SDR family) member 11
  Uniprot ID: Q6UWP2
  ENSP ID: ENSP00000477603
MFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 23530 - protein, 50 aa, Homo sapiens
  Payload ID: 4708
  Gene Symbol: DHRS11
  Gene Name: dehydrogenase/reductase (SDR family) member 11
  ENSP ID: ENSP00000482124
MARPGMERWRDRLALVTGASGGIGAAVARALVQQGLKVVGCARTVGNIEM

SEQ ID NO: 23531 - protein, 260 aa, Homo sapiens
  Payload ID: 4708
  Gene Symbol: DHRS11
  Gene Name: dehydrogenase/reductase (SDR family) member 11
  Uniprot ID: Q6UWP2
  ENSP ID: ENSP00000482704
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 23532 - protein, 150 aa, Homo sapiens
  Payload ID: 4708
  Gene Symbol: DHRS11
  Gene Name: dehydrogenase/reductase (SDR family) member 11
  ENSP ID: ENSP00000482777
MFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKP

SEQ ID NO: 23533 - protein, 109 aa, Homo sapiens
  Payload ID: 4708
  Gene Symbol: DHRS11
  Gene Name: dehydrogenase/reductase (SDR family) member 11
  ENSP ID: ENSP00000483596
NVLALSICTREAYQSMKERNVDDGHIININSMSGHRVLPLSVTHFYSATKYAVTALTEGLRQELREAQTHIRATCLKPEDVAEAVIYVLSTPAHIQIGDIQMRPTEQVT

SEQ ID NO: 23534 - protein, 260 aa, Homo sapiens; identical to SEQ ID NO: 23531
  Payload ID: 4708
  Gene Symbol: DHRS11
  Gene Name: dehydrogenase/reductase (SDR family) member 11
  Uniprot ID: Q6UWP2
  ENSP ID: ENSP00000483747

SEQ ID NO: 23535 - protein, 109 aa, Homo sapiens; identical to SEQ ID NO: 23533
  Payload ID: 4708
  Gene Symbol: DHRS11
  Gene Name: dehydrogenase/reductase (SDR family) member 11
  ENSP ID: ENSP00000487681

SEQ ID NO: 23536 - protein, 50 aa, Homo sapiens; identical to SEQ ID NO: 23530
  Payload ID: 4708
  Gene Symbol: DHRS11
  Gene Name: dehydrogenase/reductase (SDR family) member 11
  ENSP ID: ENSP00000487966

SEQ ID NO: 23537 - protein, 150 aa, Homo sapiens; identical to SEQ ID NO: 23532
  Payload ID: 4708
  Gene Symbol: DHRS11
  Gene Name: dehydrogenase/reductase (SDR family) member 11
  ENSP ID: ENSP00000488451

SEQ ID NO: 23538 - protein, 181 aa, Homo sapiens; identical to SEQ ID NO: 23529
  Payload ID: 4708
  Gene Symbol: DHRS11
  Gene Name: dehydrogenase/reductase (SDR family) member 11
  Uniprot ID: Q6UWP2
  ENSP ID: ENSP00000488610

SEQ ID NO: 23539 - protein, 242 aa, Homo sapiens
  Payload ID: 4709
  Gene Symbol: DHRS12
  Gene Name: dehydrogenase/reductase (SDR family) member 12
  Uniprot ID: A0PJE2
  ENSP ID: ENSP00000218981
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQGDFLPGCEGS

SEQ ID NO: 23540 - protein, 271 aa, Homo sapiens
  Payload ID: 4709
  Gene Symbol: DHRS12
  Gene Name: dehydrogenase/reductase (SDR family) member 12
  Uniprot ID: A0PJE2
  ENSP ID: ENSP00000280056
MNLHVKTLSLMTWRSRFLEESFWSLEETAALAKQLPLKSPSENIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPDRNEQELRKVVGEAQTASPLPRFLEIMMHEGKCQPQGHSSNDLEACWSSGGGEQNSLPDWPHQLHDLRQLTWALCSSFLLYKQGN

SEQ ID NO: 23541 - protein, 317 aa, Homo sapiens
  Payload ID: 4709
  Gene Symbol: DHRS12
  Gene Name: dehydrogenase/reductase (SDR family) member 12
  Uniprot ID: A0PJE2
  ENSP ID: ENSP00000411565
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQDRKPVSTHLPLATASSSPAEEEKLIEILEQLAQTFK

SEQ ID NO: 23542 - protein, 100 aa, Homo sapiens
  Payload ID: 4709
  Gene Symbol: DHRS12
  Gene Name: dehydrogenase/reductase (SDR family) member 12
  ENSP ID: ENSP00000478573
RELTEDGLEKNFAANTLGVYILTTGLIPVLEKEHDPRVITVSSGGMLVQKLNTNDLQSERTPFDGTMVYAQNKGAHIVCKAASTLRLPCRCCVPSEGGPV

SEQ ID NO: 23543 - protein, 377 aa, Homo sapiens
  Payload ID: 4710
  Gene Symbol: DHRS13
  Gene Name: dehydrogenase/reductase (SDR family) member 13
  Uniprot ID: Q6UX07
  ENSP ID: ENSP00000368173
MEALLLGAGLLLGAYVLVYYNLVKAPPCGGMGNLRGRTAVVTGANSGIGKMTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 23544 - protein, 327 aa, Homo sapiens
  Payload ID: 4710
  Gene Symbol: DHRS13
  Gene Name: dehydrogenase/reductase (SDR family) member 13
  Uniprot ID: Q6UX07
  ENSP ID: ENSP00000378361
MTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 23545 - protein, 296 aa, Homo sapiens
  Payload ID: 4710
  Gene Symbol: DHRS13
  Gene Name: dehydrogenase/reductase (SDR family) member 13
  Uniprot ID: Q6UX07
  ENSP ID: ENSP00000412826
MEALLLGAGLLLGAYVLVYYNLVKAPPCGGMGNLRGRTAVVTGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 23546 - protein, 280 aa, Homo sapiens
  Payload ID: 4711
  Gene Symbol: DHRS2
  Gene Name: dehydrogenase/reductase (SDR family) member 2
  Uniprot ID: Q13268
  ENSP ID: ENSP00000250383
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 23547 - protein, 300 aa, Homo sapiens
  Payload ID: 4711
  Gene Symbol: DHRS2
  Gene Name: dehydrogenase/reductase (SDR family) member 2
  Uniprot ID: Q13268
  ENSP ID: ENSP00000344674
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVVRIGFMGMSLSGRTSRNIISCRGLGSQRTVQESCPSCALQMPATSTGRTLRWQATPLGSERSGGGCVAVVPGPGA

SEQ ID NO: 23548 - protein, 225 aa, Homo sapiens
  Payload ID: 4711
  Gene Symbol: DHRS2
  Gene Name: dehydrogenase/reductase (SDR family) member 2
  ENSP ID: ENSP00000401213
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKV

SEQ ID NO: 23549 - protein, 161 aa, Homo sapiens
  Payload ID: 4711
  Gene Symbol: DHRS2
  Gene Name: dehydrogenase/reductase (SDR family) member 2
  ENSP ID: ENSP00000451485
EQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRQVGFGDLVVHVWLGRGS

SEQ ID NO: 23550 - protein, 180 aa, Homo sapiens
  Payload ID: 4711
  Gene Symbol: DHRS2
  Gene Name: dehydrogenase/reductase (SDR family) member 2
  ENSP ID: ENSP00000451895
  MOD_RES (1)..(1): Any amino acid
XSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRFHGNESLWKNFKEHHQLQRIGESEDCAGIVSFLCSPDASYVNGENIAVAGYSTRL

SEQ ID NO: 23551 - protein, 300 aa, Homo sapiens; identical to SEQ ID NO: 23547
  Payload ID: 4711
  Gene Symbol: DHRS2
  Gene Name: dehydrogenase/reductase (SDR family) member 2
  Uniprot ID: Q13268
  ENSP ID: ENSP00000481607

SEQ ID NO: 23552 - protein, 147 aa, Homo sapiens
  Payload ID: 4712
  Gene Symbol: DHRS3
  Gene Name: dehydrogenase/reductase (SDR family) member 3
  ENSP ID: ENSP00000387903
MGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRV

SEQ ID NO: 23553 - protein, 81 aa, Homo sapiens
  Payload ID: 4712
  Gene Symbol: DHRS3
  Gene Name: dehydrogenase/reductase (SDR family) member 3
  ENSP ID: ENSP00000478218
MGTECHYFICDVGNREEVYQTAKAVREKVSQPLSPTEAGDGGPEDSGSCAAQPGPPPPPMDNACPRYLEKHTSTGCTRGDP

SEQ ID NO: 23554 - protein, 302 aa, Homo sapiens
  Payload ID: 4712
  Gene Symbol: DHRS3
  Gene Name: dehydrogenase/reductase (SDR family) member 3
  Uniprot ID: O75911
  ENSP ID: ENSP00000480439
MVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 23555 - protein, 278 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000326219
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 23556 - protein, 158 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000380264
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 23557 - protein, 192 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000380265
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRRLGEPEDCAGIVSFLCSEDASYITGETVVVGGGTPSRL

SEQ ID NO: 23558 - protein, 155 aa, Homo sapiens
  Payload ID: 4713
  Gene Symbol: DHRS4
  Gene Name: dehydrogenase/reductase (SDR family) member 4
  ENSP ID: ENSP00000440508
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRR

SEQ ID NO: 23559 - protein, 244 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000452645
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 23560 - protein, 188 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000453367
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKRRLSGDRVFHSSLQSISSLDGQGKRGKHERNPADKKVRRARGLCWHRVFPVL

SEQ ID NO: 23561 - protein, 199 aa, Homo sapiens
  Payload ID: 4713
  Gene Symbol: DHRS4
  Gene Name: dehydrogenase/reductase (SDR family) member 4
  Uniprot ID: Q9BTZ2
  ENSP ID: ENSP00000453983
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPLWMDKEKEESMKETLRIRRLGEPEDCAGIVSFLCSEDASYITGETVVVGGGTPSRL

SEQ ID NO: 23562 - protein, 61 aa, Homo sapiens
  Payload ID: 4713
  Gene Symbol: DHRS4
  Gene Name: dehydrogenase/reductase (SDR family) member 4
  ENSP ID: ENSP00000454099
RNIRVNCLAPGLIKTSFSRMLWMDKEKEESMKETLRIRRPRIHKHYHYSDLSKKSASLSKG

SEQ ID NO: 23563 - protein, 232 aa, Homo sapiens
  Payload ID: 4714
  Gene Symbol: DHRS4L2
  Gene Name: dehydrogenase/reductase (SDR family) member 4 like 2
  Uniprot ID: Q6PKH6
  ENSP ID: ENSP00000334801
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 23564 - protein, 276 aa, Homo sapiens
  Payload ID: 4714
  Gene Symbol: DHRS4L2
  Gene Name: dehydrogenase/reductase (SDR family) member 4 like 2
  ENSP ID: ENSP00000372203
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLGLIKTSFSRMLWMDKEKEESMKETLRIRRLGEPEDCAGIVSFLCSEDASYITGETVVVGGGTPSRL

SEQ ID NO: 23565 - protein, 192 aa, Homo sapiens
  Payload ID: 4714
  Gene Symbol: DHRS4L2
  Gene Name: dehydrogenase/reductase (SDR family) member 4 like 2
  ENSP ID: ENSP00000380261
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKLWMDKEKEESMKETLRIRRLGEPEDCAGIVSFLCSEDASYITGETVVVGGGTPSRL

SEQ ID NO: 23566 - protein, 157 aa, Homo sapiens
  Payload ID: 4714
  Gene Symbol: DHRS4L2
  Gene Name: dehydrogenase/reductase (SDR family) member 4 like 2
  ENSP ID: ENSP00000439942
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMGFSPYNVSKTALLGLNNTLAIELAPRNIRVNCLHLDLSRLASAGCSGWTRKKRKA

SEQ ID NO: 23567 - protein, 90 aa, Homo sapiens
  Payload ID: 4714
  Gene Symbol: DHRS4L2
  Gene Name: dehydrogenase/reductase (SDR family) member 4 like 2
  ENSP ID: ENSP00000441095
MAVKLHGGIDILVSNAAVNPFFGSLMDVTEEVWDKGFSPYNVSKTALLGLNNTLAIELAPRNIRVNCLHLDLSRLASAGCSGWTRKKRKA

SEQ ID NO: 23568 - protein, 138 aa, Homo sapiens
  Payload ID: 4714
  Gene Symbol: DHRS4L2
  Gene Name: dehydrogenase/reductase (SDR family) member 4 like 2
  ENSP ID: ENSP00000441433
MAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLGLIKTSFSRMLWMDKEKEESMKETLRIEG

SEQ ID NO: 23569 - protein, 109 aa, Homo sapiens
  Payload ID: 4714
  Gene Symbol: DHRS4L2
  Gene Name: dehydrogenase/reductase (SDR family) member 4 like 2
  ENSP ID: ENSP00000452875
  MOD_RES (1)..(1): Any amino acid
XSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 23570 - protein, 48 aa, Homo sapiens
  Payload ID: 4714
  Gene Symbol: DHRS4L2
  Gene Name: dehydrogenase/reductase (SDR family) member 4 like 2
  ENSP ID: ENSP00000453173
MDVTEEVWDKTLDINVKAPALMTKAVVPEMEKRGGGSVVIVSSIAAFS

SEQ ID NO: 23571 - protein, 157 aa, Homo sapiens; identical to SEQ ID NO: 23566
  Payload ID: 4714
  Gene Symbol: DHRS4L2
  Gene Name: dehydrogenase/reductase (SDR family) member 4 like 2
  ENSP ID: ENSP00000453845

SEQ ID NO: 23572 - protein, 242 aa, Homo sapiens
  Payload ID: 4714
  Gene Symbol: DHRS4L2
  Gene Name: dehydrogenase/reductase (SDR family) member 4 like 2
  ENSP ID: ENSP00000453889
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGWLGEPEDCAGIVSFLCSEDAS

SEQ ID NO: 23573 - protein, 215 aa, Homo sapiens
  Payload ID: 4714
  Gene Symbol: DHRS4L2
  Gene Name: dehydrogenase/reductase (SDR family) member 4 like 2
  ENSP ID: ENSP00000481066
MPFPCLSLPSSWDYRIGFAIARRLAQDRAHVVVSSRKQQNVDQAVATLQGEGLSVTGTVCHVGKAEDRERLVAMTLDINVKAPALMTKAVVPEMEKRGGGSVVIVSSIAAFSPSPGFSPYNVSKTALLGLNNTLAIELAPRNIRVNCLPGLIKTSFSRMLWMDKEKEESMKETLRIRRLGEPEDCAGIVSFLCSEDASYITGETVVVGGGTPSRL

SEQ ID NO: 23574 - protein, 339 aa, Homo sapiens
  Payload ID: 4715
  Gene Symbol: DHRS7
  Gene Name: dehydrogenase/reductase (SDR family) member 7
  Uniprot ID: Q9Y394
  ENSP ID: ENSP00000216500
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 23575 - protein, 289 aa, Homo sapiens
  Payload ID: 4715
  Gene Symbol: DHRS7
  Gene Name: dehydrogenase/reductase (SDR family) member 7
  Uniprot ID: Q9Y394
  ENSP ID: ENSP00000442993
MVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 23576 - protein, 399 aa, Homo sapiens
  Payload ID: 4715
  Gene Symbol: DHRS7
  Gene Name: dehydrogenase/reductase (SDR family) member 7
  ENSP ID: ENSP00000450899
  MOD_RES (1)..(1): Any amino acid
XLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVVRPISKFLNSMYQSCRKVQNFPVFKKLSGWVQWLMSVIPALWEAKADHLRPGVQDQPGQHSETPSLLKIQKVAGHGGACL

SEQ ID NO: 23577 - protein, 160 aa, Homo sapiens
  Payload ID: 4715
  Gene Symbol: DHRS7
  Gene Name: dehydrogenase/reductase (SDR family) member 7
  ENSP ID: ENSP00000451321
  MOD_RES (1)..(1): Any amino acid
XNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRGFFNGLRTELATYPGIIVSNICPGPVQSN

SEQ ID NO: 23578 - protein, 339 aa, Homo sapiens; identical to SEQ ID NO: 23574
  Payload ID: 4715
  Gene Symbol: DHRS7
  Gene Name: dehydrogenase/reductase (SDR family) member 7
  Uniprot ID: Q9Y394
  ENSP ID: ENSP00000451882

SEQ ID NO: 23579 - protein, 212 aa, Homo sapiens
  Payload ID: 4715
  Gene Symbol: DHRS7
  Gene Name: dehydrogenase/reductase (SDR family) member 7
  ENSP ID: ENSP00000452026
  MOD_RES (1)..(1): Any amino acid
XILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLMQTLLILKSLRQNMTEKSTCTFQATGGRNGKHENSNLLMLLNNQRLICDFTF

SEQ ID NO: 23580 - protein, 61 aa, Homo sapiens
  Payload ID: 4715
  Gene Symbol: DHRS7
  Gene Name: dehydrogenase/reductase (SDR family) member 7
  ENSP ID: ENSP00000452375
MNWELLLWLLVLCALLLLLVQLLRFLRADGDLTLLWAEWQGRRPEWELTDMVVWVTGASSG

SEQ ID NO: 23581 - protein, 376 aa, Homo sapiens
  Payload ID: 4715
  Gene Symbol: DHRS7
  Gene Name: dehydrogenase/reductase (SDR family) member 7
  ENSP ID: ENSP00000483770
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITTRWGRKGLRTLRVVWMQTLLILKSLRQNMTEKSTCTFQATGGRNGKHENSNLLMLLNNQRLICDFTF

SEQ ID NO: 23582 - protein, 325 aa, Homo sapiens
  Payload ID: 4716
  Gene Symbol: DHRS7B
  Gene Name: dehydrogenase/reductase (SDR family) member 7B
  Uniprot ID: Q6IAN0
  ENSP ID: ENSP00000378887
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 23583 - protein, 125 aa, Homo sapiens
  Payload ID: 4716
  Gene Symbol: DHRS7B
  Gene Name: dehydrogenase/reductase (SDR family) member 7B
  ENSP ID: ENSP00000462139
  MOD_RES (1)..(1): Any amino acid
XIMDTTVDVDKRVMETNYFGPVALTKALLPSMIKRRQGHIVAISSIQGKMSIPFRSAFMDTTTAQGRSPVEVAQDVLAAVGKKKKDVILADLLPSLAVYLRTLAPGLFFSLMASRARKERKSKNS

SEQ ID NO: 23584 - protein, 126 aa, Homo sapiens
  Payload ID: 4716
  Gene Symbol: DHRS7B
  Gene Name: dehydrogenase/reductase (SDR family) member 7B
  ENSP ID: ENSP00000463221
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAA

SEQ ID NO: 23585 - protein, 107 aa, Homo sapiens
  Payload ID: 4716
  Gene Symbol: DHRS7B
  Gene Name: dehydrogenase/reductase (SDR family) member 7B
  ENSP ID: ENSP00000463588
MIKRRQGHIVAISSIQGKMSIPFRSAYAASKHATQAFFDCLRAEMEQYEIEVTVISPGYIHTNLSVNAITADGSRYGGKLSTSLLTWKRRVSLVFTLETVDPGKSWN

SEQ ID NO: 23586 - protein, 90 aa, Homo sapiens
  Payload ID: 4716
  Gene Symbol: DHRS7B
  Gene Name: dehydrogenase/reductase (SDR family) member 7B
  ENSP ID: ENSP00000463591
MVSPATRKSLPKVKAMDFITSTAILPLLFGCLGVFGLFRLLQWVRGKAYLRNAVVVITGATSGLGKGADTQALLGDLRPHRLWGHSCSSS

SEQ ID NO: 23587 - protein, 310 aa, Homo sapiens
  Payload ID: 4716
  Gene Symbol: DHRS7B
  Gene Name: dehydrogenase/reductase (SDR family) member 7B
  ENSP ID: ENSP00000468585
MDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 23588 - protein, 312 aa, Homo sapiens
  Payload ID: 4717
  Gene Symbol: DHRS7C
  Gene Name: dehydrogenase/reductase (SDR family) member 7C
  Uniprot ID: A6NNS2
  ENSP ID: ENSP00000327975
MGVMAMLMLPLLLLGISGLLFIYQEVSRLWSKSAVQNKVVVITDAISGLGKECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 23589 - protein, 311 aa, Homo sapiens
  Payload ID: 4717
  Gene Symbol: DHRS7C
  Gene Name: dehydrogenase/reductase (SDR family) member 7C
  Uniprot ID: A6NNS2
  ENSP ID: ENSP00000459579
MGVMAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 23590 - protein, 132 aa, Homo sapiens
  Payload ID: 4717
  Gene Symbol: DHRS7C
  Gene Name: dehydrogenase/reductase (SDR family) member 7C
  ENSP ID: ENSP00000461902
SVKVKGPAHKISLELDKKIMDANYFGPITLTKALLPNMISRRTGQIVLVNNIQGKFGIPFRTTFFFRKLTYGVHPVEVAEEVMRTVRRKKQEVFMANPIPKAAVYVRTFFPEFFFAVVACGVKEKLNVPEEG

SEQ ID NO: 23591 - protein, 319 aa, Homo sapiens
  Payload ID: 4718
  Gene Symbol: DHRS9
  Gene Name: dehydrogenase/reductase (SDR family) member 9
  Uniprot ID: Q9BPW9
  ENSP ID: ENSP00000350154
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 23592 - protein, 172 aa, Homo sapiens
  Payload ID: 4718
  Gene Symbol: DHRS9
  Gene Name: dehydrogenase/reductase (SDR family) member 9
  Uniprot ID: Q9BPW9
  ENSP ID: ENSP00000388066
MLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 23593 - protein, 319 aa, Homo sapiens; identical to SEQ ID NO: 23591
  Payload ID: 4718
  Gene Symbol: DHRS9
  Gene Name: dehydrogenase/reductase (SDR family) member 9
  Uniprot ID: Q9BPW9
  ENSP ID: ENSP00000388564

SEQ ID NO: 23594 - protein, 379 aa, Homo sapiens
  Payload ID: 4718
  Gene Symbol: DHRS9
  Gene Name: dehydrogenase/reductase (SDR family) member 9
  Uniprot ID: Q9BPW9
  ENSP ID: ENSP00000389241
MPEGRSHCACSITSLTLLVSLTRVTLDILQKLDPPQPAHWRHHLLVLYKKGVYLSHTGGKMLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 23595 - protein, 66 aa, Homo sapiens
  Payload ID: 4718
  Gene Symbol: DHRS9
  Gene Name: dehydrogenase/reductase (SDR family) member 9
  ENSP ID: ENSP00000391214
MLFWVLGLLILCGFLWTRKGKLKIEDITDKYIFITGCDSGFGNLAARTFDKKGFHVIAACLTESGS

SEQ ID NO: 23596 - protein, 319 aa, Homo sapiens; identical to SEQ ID NO: 23591
  Payload ID: 4718
  Gene Symbol: DHRS9
  Gene Name: dehydrogenase/reductase (SDR family) member 9
  Uniprot ID: Q9BPW9
  ENSP ID: ENSP00000407167

SEQ ID NO: 23597 - protein, 319 aa, Homo sapiens; identical to SEQ ID NO: 23591
  Payload ID: 4718
  Gene Symbol: DHRS9
  Gene Name: dehydrogenase/reductase (SDR family) member 9
  Uniprot ID: Q9BPW9
  ENSP ID: ENSP00000407747

SEQ ID NO: 23598 - protein, 319 aa, Homo sapiens; identical to SEQ ID NO: 23591
  Payload ID: 4718
  Gene Symbol: DHRS9
  Gene Name: dehydrogenase/reductase (SDR family) member 9
  Uniprot ID: Q9BPW9
  ENSP ID: ENSP00000473337

SEQ ID NO: 23599 - protein, 330 aa, Homo sapiens
  Payload ID: 4719
  Gene Symbol: DHRSX
  Gene Name: dehydrogenase/reductase (SDR family) X-linked
  Uniprot ID: Q8N5I4
  ENSP ID: ENSP00000334113
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWATRLAKKLLGWLLFKTPDEGAWTSIYAAVTPELEGVGGHYLYNEKETKSLHVTYNQKLQQQLWSKSCEMTGVLDVTL

SEQ ID NO: 23600 - protein, 232 aa, Homo sapiens
  Payload ID: 4719
  Gene Symbol: DHRSX
  Gene Name: dehydrogenase/reductase (SDR family) X-linked
  ENSP ID: ENSP00000391778
MSPLSAARAALRVYAVGAAVILAQLLRRCRGGFLEPVFPPRPDRVAIVTGGTDGIGYSTAKHLARLGMHVIIVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWAT

SEQ ID NO: 23601 - protein, 121 aa, Homo sapiens
  Payload ID: 4719
  Gene Symbol: DHRSX
  Gene Name: dehydrogenase/reductase (SDR family) X-linked
  ENSP ID: ENSP00000402741
MHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYV

SEQ ID NO: 23602 - protein, 63 aa, Homo sapiens
  Payload ID: 4719
  Gene Symbol: DHRSX
  Gene Name: dehydrogenase/reductase (SDR family) X-linked
  ENSP ID: ENSP00000403045
MPVFPPRPDRVAIVTGGTDGIGYSTAKHLARLGMHVIIAGNNDSKAKQVVSKIKEETLNDKET

SEQ ID NO: 23603 - protein, 154 aa, Homo sapiens
  Payload ID: 4719
  Gene Symbol: DHRSX
  Gene Name: dehydrogenase/reductase (SDR family) X-linked
  ENSP ID: ENSP00000420788
  MOD_RES (1)..(1): Any amino acid
XPARPGPTLPSPRVWPPRLSRVGLQPSSPRAAAPPRTLTPPGHGRGPGGSHAPRPRHQAALPAACGRPVTARPRQAPEGRSGRPRDLDPYPPQVFPPRPDRVAIVTGGTDGIGYSTAKHLARLGMHVIIAGNNDSKAKQVVSKIKEETLNDKET

SEQ ID NO: 23604 - protein, 161 aa, Homo sapiens
  Payload ID: 4720
  Gene Symbol: DIO1
  Gene Name: deiodinase, iodothyronine, type I
  Uniprot ID: P49895
  ENSP ID: ENSP00000323198
  MOD_RES (126)..(126): Selenocysteine
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTXPSFMFKFDQFKRLIEDFSSIADFLVIYIEEAHASG

SEQ ID NO: 23605 - protein, 249 aa, Homo sapiens
  Payload ID: 4720
  Gene Symbol: DIO1
  Gene Name: deiodinase, iodothyronine, type I
  Uniprot ID: P49895
  ENSP ID: ENSP00000354643
  MOD_RES (126)..(126): Selenocysteine
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTXPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 23606 - protein, 201 aa, Homo sapiens
  Payload ID: 4720
  Gene Symbol: DIO1
  Gene Name: deiodinase, iodothyronine, type I
  Uniprot ID: P49895
  ENSP ID: ENSP00000373528
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 23607 - protein, 82 aa, Homo sapiens
  Payload ID: 4720
  Gene Symbol: DIO1
  Gene Name: deiodinase, iodothyronine, type I
  ENSP ID: ENSP00000431999
MGLPQPGLWLKRLWVLLEVAVHVVVGKVLLILFPDRVKRNILAMGEKTGMTRNPHFSHDNWIPTFFSTQYFWFVLKVIGHWC

SEQ ID NO: 23608 - protein, 58 aa, Homo sapiens
  Payload ID: 4720
  Gene Symbol: DIO1
  Gene Name: deiodinase, iodothyronine, type I
  ENSP ID: ENSP00000432700
MGLPQPGLWLKRLWVLLEVAVHVVVGKVLLILFPDRVKRNILAMGEKTGPLAATRGHD

SEQ ID NO: 23609 - protein, 184 aa, Homo sapiens
  Payload ID: 4720
  Gene Symbol: DIO1
  Gene Name: deiodinase, iodothyronine, type I
  ENSP ID: ENSP00000432797
  MOD_RES (83)..(83): Selenocysteine
MGEKTGMTRNPHFSHDNWIPTFFSTQYFWFVLKVRWQRLEDTTELGGLAPNCPVVRLSGQRCNIWEFMQGNRPLVLNFGSCTXPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYK

SEQ ID NO: 23610 - protein, 117 aa, Homo sapiens
  Payload ID: 4720
  Gene Symbol: DIO1
  Gene Name: deiodinase, iodothyronine, type I
  ENSP ID: ENSP00000433891
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQVQEAY

SEQ ID NO: 23611 - protein, 120 aa, Homo sapiens
  Payload ID: 4720
  Gene Symbol: DIO1
  Gene Name: deiodinase, iodothyronine, type I
  ENSP ID: ENSP00000434152
MFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 23612 - protein, 113 aa, Homo sapiens
  Payload ID: 4720
  Gene Symbol: DIO1
  Gene Name: deiodinase, iodothyronine, type I
  Uniprot ID: P49895
  ENSP ID: ENSP00000434758
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQG

SEQ ID NO: 23613 - protein, 58 aa, Homo sapiens; identical to SEQ ID NO: 23608
  Payload ID: 4720
  Gene Symbol: DIO1
  Gene Name: deiodinase, iodothyronine, type I
  ENSP ID: ENSP00000435030

SEQ ID NO: 23614 - protein, 185 aa, Homo sapiens
  Payload ID: 4720
  Gene Symbol: DIO1
  Gene Name: deiodinase, iodothyronine, type I
  Uniprot ID: P49895
  ENSP ID: ENSP00000435725
  MOD_RES (62)..(62): Selenocysteine
MGLPQPGLWLKRLWVLLEVAVHVVVGKVLLILFPDRVKRNILAMGEKTGNRPLVLNFGSCTXPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 23615 - protein, 82 aa, Homo sapiens; identical to SEQ ID NO: 23607
  Payload ID: 4720
  Gene Symbol: DIO1
  Gene Name: deiodinase, iodothyronine, type I
  ENSP ID: ENSP00000436550

SEQ ID NO: 23616 - protein, 248 aa, Homo sapiens
  Payload ID: 4720
  Gene Symbol: DIO1
  Gene Name: deiodinase, iodothyronine, type I
  ENSP ID: ENSP00000479755
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 23617 - protein, 160 aa, Homo sapiens
  Payload ID: 4720
  Gene Symbol: DIO1
  Gene Name: deiodinase, iodothyronine, type I
  ENSP ID: ENSP00000481665
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTPSFMFKFDQFKRLIEDFSSIADFLVIYIEEAHASG

SEQ ID NO: 23618 - protein, 84 aa, Homo sapiens
  Payload ID: 4720
  Gene Symbol: DIO1
  Gene Name: deiodinase, iodothyronine, type I
  ENSP ID: ENSP00000483367
MGLPQPGLWLKRLWVLLEVAVHVVVGKVLLILFPDRVKRNILAMGEKTGPLAATRGHDARGSGPKLPGGPPLRTEVQHLGVYAR

SEQ ID NO: 23619 - protein, 273 aa, Homo sapiens
  Payload ID: 4721
  Gene Symbol: DIO2
  Gene Name: deiodinase, iodothyronine, type II
  Uniprot ID: Q92813
  ENSP ID: ENSP00000405854
  MOD_RES (133)..(133): Selenocysteine
  MOD_RES (266)..(266): Selenocysteine
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATXPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRXKKTRLAG

SEQ ID NO: 23620 - protein, 145 aa, Homo sapiens
  Payload ID: 4721
  Gene Symbol: DIO2
  Gene Name: deiodinase, iodothyronine, type II
  ENSP ID: ENSP00000411438
MGILSVDLLITLQILPVFFSNCLFLALYDSVILLKHVVLLLSRSKSTRGEWRRMLTSEGLRCVWKSFLLDAYKQLNCPPSGFSKDGHILLVYEAYKSRLLVYSHLDLWMTDSVVLTLNFPRQISLCFGKNSAAELYIVSKKEKVP

SEQ ID NO: 23621 - protein, 56 aa, Homo sapiens
  Payload ID: 4721
  Gene Symbol: DIO2
  Gene Name: deiodinase, iodothyronine, type II
  ENSP ID: ENSP00000450547
MGILSVDLLITLQILPPSANWWKSSPQWLTSCWSTLMRLIHQMAGRYRGTPLCLLR

SEQ ID NO: 23622 - protein, 37 aa, Homo sapiens
  Payload ID: 4721
  Gene Symbol: DIO2
  Gene Name: deiodinase, iodothyronine, type II
  ENSP ID: ENSP00000450781
  MOD_RES (1)..(1): Any amino acid
XMLTSEGLRCVWKSFLLDAYKQLNCPPSGFSKDGHIL

SEQ ID NO: 23623 - protein, 309 aa, Homo sapiens
  Payload ID: 4721
  Gene Symbol: DIO2
  Gene Name: deiodinase, iodothyronine, type II
  ENSP ID: ENSP00000450980
  MOD_RES (90)..(90): Selenocysteine
  MOD_RES (169)..(169): Selenocysteine
  MOD_RES (302)..(302): Selenocysteine
MGILSVDLLITLQILPVFFSNCLFLALYDSVILLKHVVLLLSRSKSTRGEWRRMLTSEGLRCVWKSFLLDAYKQLNCPPSGFSKDGHILXLVYEAYKSRLLVYSHLDLWMVKLGEDAPNSSVVHVSSTEGGDNSGNGTQEKIAEGATCHLLDFASPERPLVVNFGSATXPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRXKKTRLAG

SEQ ID NO: 23624 - protein, 54 aa, Homo sapiens
  Payload ID: 4721
  Gene Symbol: DIO2
  Gene Name: deiodinase, iodothyronine, type II
  ENSP ID: ENSP00000451136
MGILSVDLLITLQILPVFFSNCLFLALYDSVILLKHVVLLLSRSKSTRGEWRRM

SEQ ID NO: 23625 - protein, 6 aa, Homo sapiens
  Payload ID: 4721
  Gene Symbol: DIO2
  Gene Name: deiodinase, iodothyronine, type II
  ENSP ID: ENSP00000451265
MGILSV

SEQ ID NO: 23626 - protein, 6 aa, Homo sapiens
  Payload ID: 4721
  Gene Symbol: DIO2
  Gene Name: deiodinase, iodothyronine, type II
  ENSP ID: ENSP00000451339
MGILSV

SEQ ID NO: 23627 - protein, 273 aa, Homo sapiens; identical to SEQ ID NO: 23619
  Payload ID: 4721
  Gene Symbol: DIO2
  Gene Name: deiodinase, iodothyronine, type II
  Uniprot ID: Q92813
  ENSP ID: ENSP00000451419
  MOD_RES (133)..(133): Selenocysteine
  MOD_RES (266)..(266): Selenocysteine

SEQ ID NO: 23628 - protein, 58 aa, Homo sapiens
  Payload ID: 4721
  Gene Symbol: DIO2
  Gene Name: deiodinase, iodothyronine, type II
  ENSP ID: ENSP00000451971
  MOD_RES (1)..(1): Any amino acid
XMLTSEGLRCVWKSFLLDAYKQTDSVVLTLNFPRQISLCFGKNSAAELYIVSKKEKVP

SEQ ID NO: 23629 - protein, 304 aa, Homo sapiens
  Payload ID: 4722
  Gene Symbol: DIO3
  Gene Name: deiodinase, iodothyronine, type III
  Uniprot ID: P55073
  ENSP ID: ENSP00000427336
  MOD_RES (170)..(170): Selenocysteine
MPRQATSRLVVGEGEGSQGASGPAATMLRSLLLHSLRLCAQTASCLVLFPRFLGTAFMLWLLDFLCIRKHFLGRRRRGQPEPEVELNSEGEEVPPDDPPICVSDDNRLCTLASLKAVWHGQKLDFFKQAHEGGPAPNSEVVLPDGFQSQHILDYAQGNRPLVLNFGSCTXPPFMARMSAFQRLVTKYQRDVDFLIIYIEEAHPSDGWVTTDSPYIIPQHRSLEDRVSAARVLQQGAPGCALVLDTMANSSSSAYGAYFERLYVIQSGTIMYQGGRGPDGYQVSELRTWLERYDEQLHGARPRRV

SEQ ID NO: 23630 - protein, 341 aa, Homo sapiens
  Payload ID: 4723
  Gene Symbol: DEK
  Gene Name: DEK proto-oncogene
  Uniprot ID: P35659
  ENSP ID: ENSP00000244776
MSASAPAAEGEGTPTQPASEKEPEMPGPREESEEEEDEDDEEEEEEEKGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 23631 - protein, 375 aa, Homo sapiens
  Payload ID: 4723
  Gene Symbol: DEK
  Gene Name: DEK proto-oncogene
  Uniprot ID: P35659
  ENSP ID: ENSP00000380414
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 23632 - protein, 347 aa, Homo sapiens
  Payload ID: 4723
  Gene Symbol: DEK
  Gene Name: DEK proto-oncogene
  ENSP ID: ENSP00000421165
MSASAPAAEGEGTPTQPASEKEPEMPGPREESEEEEDEDDEEEEEEEKEKSLIVEGKREKKKVERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 23633 - protein, 161 aa, Homo sapiens
  Payload ID: 4723
  Gene Symbol: DEK
  Gene Name: DEK proto-oncogene
  ENSP ID: ENSP00000422380
  MOD_RES (1)..(1): Any amino acid
XNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEYNLSAVRTEFWLCDRRLFWRPSFKSPAAYKS

SEQ ID NO: 23634 - protein, 156 aa, Homo sapiens
  Payload ID: 4723
  Gene Symbol: DEK
  Gene Name: DEK proto-oncogene
  ENSP ID: ENSP00000423427
ILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKEVNISVFQV

SEQ ID NO: 23635 - protein, 151 aa, Homo sapiens
  Payload ID: 4723
  Gene Symbol: DEK
  Gene Name: DEK proto-oncogene
  ENSP ID: ENSP00000423553
MQVHSMSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKE

SEQ ID NO: 23636 - protein, 122 aa, Homo sapiens
  Payload ID: 4723
  Gene Symbol: DEK
  Gene Name: DEK proto-oncogene
  ENSP ID: ENSP00000425399
MQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPS

SEQ ID NO: 23637 - protein, 613 aa, Homo sapiens
  Payload ID: 4724
  Gene Symbol: DAZ1
  Gene Name: deleted in azoospermia 1
  Uniprot ID: Q9NQZ3
  ENSP ID: ENSP00000371950
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVCEICKILVLKNAAAFLCHSKVNRSI

SEQ ID NO: 23638 - protein, 744 aa, Homo sapiens
  Payload ID: 4724
  Gene Symbol: DAZ1
  Gene Name: deleted in azoospermia 1
  Uniprot ID: Q9NQZ3
  ENSP ID: ENSP00000384573
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23639 - protein, 366 aa, Homo sapiens
  Payload ID: 4724
  Gene Symbol: DAZ1
  Gene Name: deleted in azoospermia 1
  ENSP ID: ENSP00000400716
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQPFPAYPSSPFQVTAGYQLPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23640 - protein, 390 aa, Homo sapiens
  Payload ID: 4724
  Gene Symbol: DAZ1
  Gene Name: deleted in azoospermia 1
  ENSP ID: ENSP00000444407
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23641 - protein, 486 aa, Homo sapiens [sequence omitted]

SEQ ID NO: 23642 - protein, 366 aa, Homo sapiens
  Payload ID: 4725
  Gene Symbol: DAZ2
  Gene Name: deleted in azoospermia 2
  ENSP ID: ENSP00000371731
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPSSPFQVTAGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23643 - protein, 534 aa, Homo sapiens
  Payload ID: 4725
  Gene Symbol: DAZ2
  Gene Name: deleted in azoospermia 2
  Uniprot ID: Q13117
  ENSP ID: ENSP00000371743
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23644 - protein, 558 aa, Homo sapiens
  Payload ID: 4725
  Gene Symbol: DAZ2
  Gene Name: deleted in azoospermia 2
  Uniprot ID: Q13117
  ENSP ID: ENSP00000371861
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23645 - protein, 486 aa, Homo sapiens
  Payload ID: 4725
  Gene Symbol: DAZ2
  Gene Name: deleted in azoospermia 2
  ENSP ID: ENSP00000371868
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23646 - protein, 558 aa, Homo sapiens; identical to SEQ ID NO: 23644
  Payload ID: 4725
  Gene Symbol: DAZ2
  Gene Name: deleted in azoospermia 2
  Uniprot ID: Q13117
  ENSP ID: ENSP00000371870

SEQ ID NO: 23647 - protein, 654 aa, Homo sapiens
  Payload ID: 4725
  Gene Symbol: DAZ2
  Gene Name: deleted in azoospermia 2
  ENSP ID: ENSP00000371877
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23648 - protein, 534 aa, Homo sapiens; identical to SEQ ID NO: 23643
  Payload ID: 4725
  Gene Symbol: DAZ2
  Gene Name: deleted in azoospermia 2
  Uniprot ID: Q13117
  ENSP ID: ENSP00000371887

SEQ ID NO: 23649 - protein, 438 aa, Homo sapiens
  Payload ID: 4725
  Gene Symbol: DAZ2
  Gene Name: deleted in azoospermia 2
  ENSP ID: ENSP00000383340
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPFQVATGYQFPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23650 - protein, 390 aa, Homo sapiens; identical to SEQ ID NO: 23640
  Payload ID: 4725
  Gene Symbol: DAZ2
  Gene Name: deleted in azoospermia 2
  ENSP ID: ENSP00000414113

SEQ ID NO: 23651 - protein, 366 aa, Homo sapiens
  Payload ID: 4726
  Gene Symbol: DAZ3
  Gene Name: deleted in azoospermia 3
  ENSP ID: ENSP00000324965
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPVQVTTGYQLPVYNYQAFPAYPNSPVQVTTGYQLPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23652 - protein, 438 aa, Homo sapiens
  Payload ID: 4726
  Gene Symbol: DAZ3
  Gene Name: deleted in azoospermia 3
  Uniprot ID: Q9NR90
  ENSP ID: ENSP00000371802
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23653 - protein, 390 aa, Homo sapiens
  Payload ID: 4726
  Gene Symbol: DAZ3
  Gene Name: deleted in azoospermia 3
  ENSP ID: ENSP00000401049
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23654 - protein, 651 aa, Homo sapiens
  Payload ID: 4727
  Gene Symbol: DAZ4
  Gene Name: deleted in azoospermia 4
  ENSP ID: ENSP00000371733
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23655 - protein, 603 aa, Homo sapiens
  Payload ID: 4727
  Gene Symbol: DAZ4
  Gene Name: deleted in azoospermia 4
  ENSP ID: ENSP00000371751
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 23656 - protein, 558 aa, Homo sapiens
  Payload ID: 4727
  Gene Symbol: DAZ4
  Gene Name: deleted in azoospermia 4
  ENSP ID: ENSP00000371869
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23657 - protein, 390 aa, Homo sapiens; identical to SEQ ID NO: 23640
  Payload ID: 4727
  Gene Symbol: DAZ4
  Gene Name: deleted in azoospermia 4
  Uniprot ID: Q86SG3
  ENSP ID: ENSP00000389300

SEQ ID NO: 23658 - protein, 366 aa, Homo sapiens; identical to SEQ ID NO: 23642
  Payload ID: 4727
  Gene Symbol: DAZ4
  Gene Name: deleted in azoospermia 4
  ENSP ID: ENSP00000397895

SEQ ID NO: 23659 - protein, 486 aa, Homo sapiens
  Payload ID: 4727
  Gene Symbol: DAZ4
  Gene Name: deleted in azoospermia 4
  ENSP ID: ENSP00000401363
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23660 - protein, 579 aa, Homo sapiens
  Payload ID: 4727
  Gene Symbol: DAZ4
  Gene Name: deleted in azoospermia 4
  ENSP ID: ENSP00000489430
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 23661 - protein, 315 aa, Homo sapiens
  Payload ID: 4728
  Gene Symbol: DAZL
  Gene Name: deleted in azoospermia-like
  Uniprot ID: Q92904
  ENSP ID: ENSP00000250863
MAAPSCGGDRKARLTPSLPHESTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 23662 - protein, 295 aa, Homo sapiens
  Payload ID: 4728
  Gene Symbol: DAZL
  Gene Name: deleted in azoospermia-like
  Uniprot ID: Q92904
  ENSP ID: ENSP00000382373
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 23663 - protein, 204 aa, Homo sapiens
  Payload ID: 4728
  Gene Symbol: DAZL
  Gene Name: deleted in azoospermia-like
  ENSP ID: ENSP00000398109
MGADPYHSSAQCLSILFSLSLHSPGLPVLMSSSLLLLPKSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQ

SEQ ID NO: 23664 - protein, 70 aa, Homo sapiens
  Payload ID: 4729
  Gene Symbol: DEC1
  Gene Name: deleted in esophageal cancer 1
  Uniprot ID: Q9P2X7
  ENSP ID: ENSP00000363128
MTMNVLEAGKWKSIVPAPGEGLLAVLHMMVFTDALHRERSVKWQAGVCYNGGKDFAVSLARPKAAEGIAD

SEQ ID NO: 23665 - protein, 70 aa, Homo sapiens
  Payload ID: 4729
  Gene Symbol: DEC1
  Gene Name: deleted in esophageal cancer 1
  ENSP ID: ENSP00000477682
LFLPVLEAGKWKSIVPAPGEGLLAVLHMMVFTDALHRERSVKWQAGVCYNGGKDFAVSLARPKAAEGIGN

SEQ ID NO: 23666 - protein, 1755 aa, Homo sapiens
  Payload ID: 4730
  Gene Symbol: DLEC1
  Gene Name: deleted in lung and esophageal cancer 1
  Uniprot ID: Q9Y238
  ENSP ID: ENSP00000308597
METRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPGKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 23667 - protein, 1778 aa, Homo sapiens
  Payload ID: 4730
  Gene Symbol: DLEC1
  Gene Name: deleted in lung and esophageal cancer 1
  Uniprot ID: Q9Y238
  ENSP ID: ENSP00000315914
METRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPGKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGVVSCTSPRWWWKVCSVRSPAPCGSGAKAPMMRDTCCLTSPEAPPQPSAPGPSWRKNIAQGLGAALQHKDTDLGTWGPLGSSWNGRTPFHNGLSLGPHDMSSELT

SEQ ID NO: 23668 - protein, 82 aa, Homo sapiens
  Payload ID: 4730
  Gene Symbol: DLEC1
  Gene Name: deleted in lung and esophageal cancer 1
  ENSP ID: ENSP00000404261
PPKKPAPIGEFQSTEPEQSCADTPVFLAKPPIGFFTDYEIGPVYEMVIALQNTTTTSRYLRVLPPSTPYFALGLGHCNRRLC

SEQ ID NO: 23669 - protein, 78 aa, Homo sapiens
  Payload ID: 4731
  Gene Symbol: DLEU1
  Gene Name: deleted in lymphocytic leukemia 1 (non-protein coding)
  Uniprot ID: O43261
  ENSP ID: ENSP00000367422
MRPCIWIHVHLKPPCRLVELLPFSSALQGLSHLSLGTTLPVILPERNEEQNLQELSHNADKYQMGDCCKEEIDDSIFY

SEQ ID NO: 23670 - protein, 44 aa, Homo sapiens
  Payload ID: 4731
  Gene Symbol: DLEU1
  Gene Name: deleted in lymphocytic leukemia 1 (non-protein coding)
  ENSP ID: ENSP00000483301
MRPCIWIHVHLKPPCRLVELLPFSSALQGLSHLSLGTTLPDEDT

SEQ ID NO: 23671 - protein, 160 aa, Homo sapiens
  Payload ID: 4732
  Gene Symbol: DLEU7
  Gene Name: deleted in lymphocytic leukemia, 7
  Uniprot ID: Q6UYE1
  ENSP ID: ENSP00000420976
MASPAPLVASISHQMVALQTLQLLQQEWGWGDGPVAPGNPRDPDHVSTAPARRSGPPRARPGPGREERGGGVGTRSRRTAARANSPEEEVVRGAEGGAELLPFPRDRGPCTLAQMAMRSALARVVDSTSELVSVEQTLLGPLQQERSFPIHLKLQLLANE

SEQ ID NO: 23672 - protein, 221 aa, Homo sapiens
  Payload ID: 4732
  Gene Symbol: DLEU7
  Gene Name: deleted in lymphocytic leukemia, 7
  Uniprot ID: Q6UYE1
  ENSP ID: ENSP00000427177
MASPAPLVASISHQMVALQTLQLLQQEWGWGDGPVAPGNPRDPDHVSTAPARRSGPPRARPGPGREERGGGVGTRSRRTAARANSPEEEVVRGAEGGAELLPFPRDRGPCTLAQMAMRSALARVVDSTSELVSVEQTLLGPLQQERSFPIHLKDSVEFRNICSHLALQIEGQQFDRDLNAAHQCLKTIVKKLIQSLANFPSDAHMVACASLRQILQNLPDI

SEQ ID NO: 23673 - protein, 1785 aa, Homo sapiens
  Payload ID: 4733
  Gene Symbol: DMBT1
  Gene Name: deleted in malignant brain tumors 1
  Uniprot ID: Q9UGM3
  ENSP ID: ENSP00000327747
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 23674 - protein, 2413 aa, Homo sapiens
  Payload ID: 4733
  Gene Symbol: DMBT1
  Gene Name: deleted in malignant brain tumors 1
  Uniprot ID: Q9UGM3
  ENSP ID: ENSP00000342210
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 23675 - protein, 2403 aa, Homo sapiens
  Payload ID: 4733
  Gene Symbol: DMBT1
  Gene Name: deleted in malignant brain tumors 1
  Uniprot ID: Q9UGM3
  ENSP ID: ENSP00000343175
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 23676 - protein, 1133 aa, Homo sapiens
  Payload ID: 4733
  Gene Symbol: DMBT1
  Gene Name: deleted in malignant brain tumors 1
  Uniprot ID: Q9UGM3
  ENSP ID: ENSP00000352593
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAPQSRPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 23677 - protein, 2413 aa, Homo sapiens; identical to SEQ ID NO: 23674
  Payload ID: 4733
  Gene Symbol: DMBT1
  Gene Name: deleted in malignant brain tumors 1
  Uniprot ID: Q9UGM3
  ENSP ID: ENSP00000357905

SEQ ID NO: 23678 - protein, 2403 aa, Homo sapiens; identical to SEQ ID NO: 23675
  Payload ID: 4733
  Gene Symbol: DMBT1
  Gene Name: deleted in malignant brain tumors 1
  Uniprot ID: Q9UGM3
  ENSP ID: ENSP00000357951

SEQ ID NO: 23679 - protein, 1785 aa, Homo sapiens; identical to SEQ ID NO: 23673
  Payload ID: 4733
  Gene Symbol: DMBT1
  Gene Name: deleted in malignant brain tumors 1
  Uniprot ID: Q9UGM3
  ENSP ID: ENSP00000357952

SEQ ID NO: 23680 - protein, 2413 aa, Homo sapiens; identical to SEQ ID NO: 23674
  Payload ID: 4733
  Gene Symbol: DMBT1
  Gene Name: deleted in malignant brain tumors 1
  Uniprot ID: Q9UGM3
  ENSP ID: ENSP00000484603

SEQ ID NO: 23681 - protein, 170 aa, Homo sapiens
  Payload ID: 4734
  Gene Symbol: DPCD
  Gene Name: deleted in primary ciliary dyskinesia homolog (mouse)
  ENSP ID: ENSP00000359166
MAVTGWLESLRTAQKTALLQDGRRKVHYLFPDGKEMAEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKKRTGWRLLWTPLAMRCAGVHGTPSEIDTSYLWMTPC

SEQ ID NO: 23682 - protein, 203 aa, Homo sapiens
  Payload ID: 4734
  Gene Symbol: DPCD
  Gene Name: deleted in primary ciliary dyskinesia homolog (mouse)
  Uniprot ID: Q9BVM2
  ENSP ID: ENSP00000359170
MAVTGWLESLRTAQKTALLQDGRRKVHYLFPDGKEMAEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKKYYKKFSIPDLDRHQLPLDDALLSFAHANCTLIISYQKPKEVVVAESELQKELKKVKTAHSNDGDCKTQ

SEQ ID NO: 23683 - protein, 116 aa, Homo sapiens
  Payload ID: 4734
  Gene Symbol: DPCD
  Gene Name: deleted in primary ciliary dyskinesia homolog (mouse)
  ENSP ID: ENSP00000403505
AEEYDEKTSELLVRKWRVKSALGAMGQWQLEVGDPAPLGAGNLGPELIKESNANPIFMRKDTKMSFQWRIRNLPYPKDVYSVSVDQKERCIIVRTTNKNTRSQRRLWWPSLSYRRN

SEQ ID NO: 23684 - protein, 170 aa, Homo sapiens; identical to SEQ ID NO: 23681
  Payload ID: 4734
  Gene Symbol: DPCD
  Gene Name: deleted in primary ciliary dyskinesia homolog (mouse)
  ENSP ID: ENSP00000486078

SEQ ID NO: 23685 - protein, 323 aa, Homo sapiens
  Payload ID: 4735
  Gene Symbol: DEGS1
  Gene Name: delta(4)-desaturase, sphingolipid 1
  Uniprot ID: O15121
  ENSP ID: ENSP00000316476
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 23686 - protein, 323 aa, Homo sapiens; identical to SEQ ID NO: 23685
  Payload ID: 4735
  Gene Symbol: DEGS1
  Gene Name: delta(4)-desaturase, sphingolipid 1
  Uniprot ID: O15121
  ENSP ID: ENSP00000375749

SEQ ID NO: 23687 - protein, 261 aa, Homo sapiens
  Payload ID: 4735
  Gene Symbol: DEGS1
  Gene Name: delta(4)-desaturase, sphingolipid 1
  ENSP ID: ENSP00000400545
MVSPQLAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAE

SEQ ID NO: 23688 - protein, 323 aa, Homo sapiens
  Payload ID: 4736
  Gene Symbol: DEGS2
  Gene Name: delta(4)-desaturase, sphingolipid 2
  Uniprot ID: Q6QHC5
  ENSP ID: ENSP00000307126
MGNSASRSDFEWVYTDQPHTQRRKEILAKYPAIKALMRPDPRLKWAVLVLVLVQMLACWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 23689 - protein, 54 aa, Homo sapiens
  Payload ID: 4736
  Gene Symbol: DEGS2
  Gene Name: delta(4)-desaturase, sphingolipid 2
  ENSP ID: ENSP00000450637
MGNSASRSDFEWVYTDQPHTQRRKEILGAEDRARVLRPPAAAPLLGEGALGFCV

SEQ ID NO: 23690 - protein, 737 aa, Homo sapiens
  Payload ID: 4737
  Gene Symbol: DNER
  Gene Name: delta/notch-like EGF repeat containing
  Uniprot ID: Q8NFT8
  ENSP ID: ENSP00000345229
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 23691 - protein, 723 aa, Homo sapiens
  Payload ID: 4738
  Gene Symbol: DLL1
  Gene Name: delta-like 1 (Drosophila)
  Uniprot ID: O00548
  ENSP ID: ENSP00000355718
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 23692 - protein, 723 aa, Homo sapiens; identical to SEQ ID NO: 23691
  Payload ID: 4738
  Gene Symbol: DLL1
  Gene Name: delta-like 1 (Drosophila)
  Uniprot ID: O00548
  ENSP ID: ENSP00000480905

SEQ ID NO: 23693 - protein, 54 aa, Homo sapiens
  Payload ID: 4738
  Gene Symbol: DLL1
  Gene Name: delta-like 1 (Drosophila)
  ENSP ID: ENSP00000486351
MGSRCALALAVLSALLCQVWSSGVFELKLQEFVNKKGLLGNRNCCRGGAGPPPC

SEQ ID NO: 23694 - protein, 54 aa, Homo sapiens; identical to SEQ ID NO: 23693
  Payload ID: 4738
  Gene Symbol: DLL1
  Gene Name: delta-like 1 (Drosophila)
  ENSP ID: ENSP00000487173

SEQ ID NO: 23695 - protein, 310 aa, Homo sapiens
  Payload ID: 4739
  Gene Symbol: DLK1
  Gene Name: delta-like 1 homolog (Drosophila)
  Uniprot ID: P80370
  ENSP ID: ENSP00000331081
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 23696 - protein, 383 aa, Homo sapiens
  Payload ID: 4739
  Gene Symbol: DLK1
  Gene Name: delta-like 1 homolog (Drosophila)
  Uniprot ID: P80370
  ENSP ID: ENSP00000340292
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 23697 - protein, 97 aa, Homo sapiens
  Payload ID: 4739
  Gene Symbol: DLK1
  Gene Name: delta-like 1 homolog (Drosophila)
  ENSP ID: ENSP00000376589
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPC

SEQ ID NO: 23698 - protein, 136 aa, Homo sapiens
  Payload ID: 4739
  Gene Symbol: DLK1
  Gene Name: delta-like 1 homolog (Drosophila)
  ENSP ID: ENSP00000450821
MTATEALLRVLLLLLAFGHSTYGAECFPACNPQNGFCEDDNVCRCQPGWQGPLCDQCVTSPGCLHGLCGEPGQCICTDGWDGELCDRGWHSPLFTSALRPYLPALAPTTSSQSPVAGVPHFLIPAHSVPCILKICL

SEQ ID NO: 23699 - protein, 383 aa, Homo sapiens
  Payload ID: 4740
  Gene Symbol: DLK2
  Gene Name: delta-like 2 homolog (Drosophila)
  Uniprot ID: Q6UY11
  ENSP ID: ENSP00000349893
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 23700 - protein, 377 aa, Homo sapiens
  Payload ID: 4740
  Gene Symbol: DLK2
  Gene Name: delta-like 2 homolog (Drosophila)
  ENSP ID: ENSP00000361563
MPSGCRCLHLVCLLCILGAPGQPVRADDCSSHCDLAHGCCAPDGSCRCDPGWEGLHCERCVRMPGCQHGTCHQPWQCICHSGWADEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 23701 - protein, 383 aa, Homo sapiens; identical to SEQ ID NO: 23699
  Payload ID: 4740
  Gene Symbol: DLK2
  Gene Name: delta-like 2 homolog (Drosophila)
  Uniprot ID: Q6UY11
  ENSP ID: ENSP00000361566

SEQ ID NO: 23702 - protein, 289 aa, Homo sapiens
  Payload ID: 4740
  Gene Symbol: DLK2
  Gene Name: delta-like 2 homolog (Drosophila)
  ENSP ID: ENSP00000399829
  MOD_RES (1)..(1): Any amino acid
XGCQHGTCHQPWQCICHSGWAGKFCDKGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 23703 - protein, 618 aa, Homo sapiens
  Payload ID: 4741
  Gene Symbol: DLL3
  Gene Name: delta-like 3 (Drosophila)
  Uniprot ID: Q9NYJ7
  ENSP ID: ENSP00000205143
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 23704 - protein, 587 aa, Homo sapiens
  Payload ID: 4741
  Gene Symbol: DLL3
  Gene Name: delta-like 3 (Drosophila)
  Uniprot ID: Q9NYJ7
  ENSP ID: ENSP00000348810
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 23705 - protein, 220 aa, Homo sapiens
  Payload ID: 4741
  Gene Symbol: DLL3
  Gene Name: delta-like 3 (Drosophila)
  ENSP ID: ENSP00000471688
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGGLCLDLGHALRCRCRAGFAGPRCEHDLDDCAGRACANGGTCVEGGGAHRCSCALGFGGRDCRERADPCAARPCAHGGRCYAHF

SEQ ID NO: 23706 - protein, 685 aa, Homo sapiens
  Payload ID: 4742
  Gene Symbol: DLL4
  Gene Name: delta-like 4 (Drosophila)
  Uniprot ID: Q9NR61
  ENSP ID: ENSP00000249749
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 23707 - protein, 620 aa, Homo sapiens
  Payload ID: 4743
  Gene Symbol: DTX1
  Gene Name: deltex 1, E3 ubiquitin ligase
  Uniprot ID: Q86Y01
  ENSP ID: ENSP00000257600
MSRPGHGGLMPVNGLGFPPQNVARVVVWEWLNEHSRWRPYTATVCHHIENVLKEDARGSVVLGQVDAQLVPYIIDLQSMHQFRQDTGTMRPVRRNFYDPSSAPGKGIVWEWENDGGAWTAYDMDICITIQNAYEKQHPWLDLSSLGFCYLIYFNSMSQMNRQTRRRRRLRRRLDLAYPLTVGSIPKSQSWPVGASSGQPCSCQQCLLVNSTRAASNAILASQRRKAPPAPPLPPPPPPGGPPGALAVRPSATFTGAALWAAPAAGPAEPAPPPGAPPRSPGAPGGARTPGQNNLNRPGPQRTTSVSARASIPPGVPALPVKNLNGTGPVHPALAGMTGILLCAAGLPVCLTRAPKPILHPPPVSKSDVKPVPGVPGVCRKTKKKHLKKSKNPEDVVRRYMQKVKNPPDEDCTICMERLVTASGYEGVLRHKGVRPELVGRLGRCGHMYHLLCLVAMYSNGNKDGSLQCPTCKAIYGEKTGTQPPGKMEFHLIPHSLPGFPDTQTIRIVYDIPTGIQGPEHPNPGKKFTARGFPRHCYLPNNEKGRKVLRLLITAWERRLIFTIGTSNTTGESDTVVWNEIHHKTEFGSNLTGHGYPDASYLDNVLAELTAQGVSEAAAKA

SEQ ID NO: 23708 - protein, 622 aa, Homo sapiens
  Payload ID: 4744
  Gene Symbol: DTX2
  Gene Name: deltex 2, E3 ubiquitin ligase
  Uniprot ID: Q86UW9
  ENSP ID: ENSP00000322885
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 23709 - protein, 89 aa, Homo sapiens
  Payload ID: 4744
  Gene Symbol: DTX2
  Gene Name: deltex 2, E3 ubiquitin ligase
  ENSP ID: ENSP00000387894
MAMAPSPSLVQVYTSPAAVAVWEWQDGLGTWHPYSATVCSFIEQQFVQQKGQRFGLGSLAHSIPLGQADPSLAPYIIDLPSWTQFRQDT

SEQ ID NO: 23710 - protein, 28 aa, Homo sapiens
  Payload ID: 4744
  Gene Symbol: DTX2
  Gene Name: deltex 2, E3 ubiquitin ligase
  ENSP ID: ENSP00000389231
MAMAPSPSLVQVYTSPAAVAVWEWQDGL

SEQ ID NO: 23711 - protein, 622 aa, Homo sapiens; identical to SEQ ID NO: 23708
  Payload ID: 4744
  Gene Symbol: DTX2
  Gene Name: deltex 2, E3 ubiquitin ligase
  Uniprot ID: Q86UW9
  ENSP ID: ENSP00000390218

SEQ ID NO: 23712 - protein, 62 aa, Homo sapiens
  Payload ID: 4744
  Gene Symbol: DTX2
  Gene Name: deltex 2, E3 ubiquitin ligase
  ENSP ID: ENSP00000390881
MAMAPSPSLVQVYTSPAAVAVWEWQDGLGTWHPYSATVCSFIEQQFVQQKGQRFGLGSLAHS

SEQ ID NO: 23713 - protein, 14 aa, Homo sapiens
  Payload ID: 4744
  Gene Symbol: DTX2
  Gene Name: deltex 2, E3 ubiquitin ligase
  ENSP ID: ENSP00000392114
MAMAPSPSLVQVYT

SEQ ID NO: 23714 - protein, 575 aa, Homo sapiens
  Payload ID: 4744
  Gene Symbol: DTX2
  Gene Name: deltex 2, E3 ubiquitin ligase
  Uniprot ID: Q86UW9
  ENSP ID: ENSP00000392545
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 23715 - protein, 531 aa, Homo sapiens
  Payload ID: 4744
  Gene Symbol: DTX2
  Gene Name: deltex 2, E3 ubiquitin ligase
  ENSP ID: ENSP00000397648
MRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 23716 - protein, 89 aa, Homo sapiens; identical to SEQ ID NO: 23709
  Payload ID: 4744
  Gene Symbol: DTX2
  Gene Name: deltex 2, E3 ubiquitin ligase
  ENSP ID: ENSP00000399639

SEQ ID NO: 23717 - protein, 108 aa, Homo sapiens
  Payload ID: 4744
  Gene Symbol: DTX2
  Gene Name: deltex 2, E3 ubiquitin ligase
  ENSP ID: ENSP00000403342
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGR

SEQ ID NO: 23718 - protein, 65 aa, Homo sapiens
  Payload ID: 4744
  Gene Symbol: DTX2
  Gene Name: deltex 2, E3 ubiquitin ligase
  ENSP ID: ENSP00000407398
MAMAPSPSLVQVYTSPAAVAVWEWQDGLGTWHPYSATVCSFIEQQFVQQKGQRFGLGSLAHSIPL

SEQ ID NO: 23719 - protein, 25 aa, Homo sapiens
  Payload ID: 4744
  Gene Symbol: DTX2
  Gene Name: deltex 2, E3 ubiquitin ligase
  ENSP ID: ENSP00000409040
MAMAPSPSLVQVYTSPAAVAVWEWQ

SEQ ID NO: 23720 - protein, 87 aa, Homo sapiens
  Payload ID: 4744
  Gene Symbol: DTX2
  Gene Name: deltex 2, E3 ubiquitin ligase
  ENSP ID: ENSP00000410892
  MOD_RES (1)..(1): Any amino acid
XASLPSGPSSSPGSVPATVPMQMPKPSRVQQALAGATPKPEPEPEQVIKNYTEELKVPPDESVESMRKIWTASSAWRSCPQRLDTAM

SEQ ID NO: 23721 - protein, 622 aa, Homo sapiens; identical to SEQ ID NO: 23708
  Payload ID: 4744
  Gene Symbol: DTX2
  Gene Name: deltex 2, E3 ubiquitin ligase
  Uniprot ID: Q86UW9
  ENSP ID: ENSP00000411986

SEQ ID NO: 23722 - protein, 140 aa, Homo sapiens
  Payload ID: 4744
  Gene Symbol: DTX2
  Gene Name: deltex 2, E3 ubiquitin ligase
  ENSP ID: ENSP00000415838
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGN

SEQ ID NO: 23723 - protein, 212 aa, Homo sapiens
  Payload ID: 4744
  Gene Symbol: DTX2
  Gene Name: deltex 2, E3 ubiquitin ligase
  ENSP ID: ENSP00000487729
DCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 23724 - protein, 212 aa, Homo sapiens; identical to SEQ ID NO: 23723
  Payload ID: 4744
  Gene Symbol: DTX2
  Gene Name: deltex 2, E3 ubiquitin ligase
  ENSP ID: ENSP00000487782

SEQ ID NO: 23725 - protein, 212 aa, Homo sapiens; identical to SEQ ID NO: 23723
  Payload ID: 4744
  Gene Symbol: DTX2
  Gene Name: deltex 2, E3 ubiquitin ligase
  ENSP ID: ENSP00000488350

SEQ ID NO: 23726 - protein, 26 aa, Homo sapiens
  Payload ID: 4744
  Gene Symbol: DTX2
  Gene Name: deltex 2, E3 ubiquitin ligase
  ENSP ID: ENSP00000488433
SVESMRKIWTASSAWRSCPQRLDTAM

SEQ ID NO: 23727 - protein, 212 aa, Homo sapiens; identical to SEQ ID NO: 23723
  Payload ID: 4744
  Gene Symbol: DTX2
  Gene Name: deltex 2, E3 ubiquitin ligase
  ENSP ID: ENSP00000488533

SEQ ID NO: 23728 - protein, 212 aa, Homo sapiens; identical to SEQ ID NO: 23723
  Payload ID: 4744
  Gene Symbol: DTX2
  Gene Name: deltex 2, E3 ubiquitin ligase
  ENSP ID: ENSP00000488660

SEQ ID NO: 23729 - protein, 740 aa, Homo sapiens
  Payload ID: 4745
  Gene Symbol: DTX3L
  Gene Name: deltex 3 like, E3 ubiquitin ligase
  Uniprot ID: Q8TDB6
  ENSP ID: ENSP00000296161
MASHLRPPSPLLVRVYKSGPRVRRKLESYFQSSKSSGGGECTVSTQEHEAPGTFRVEFSERAAKERVLKKGEHQILVDEKPVPIFLVPTENSIKKNTRPQISSLTQSQAETPSGDMHQHEGHIPNAVDSCLQKIFLTVTADLNCNLFSKEQRAYITTLCPSIRKMEGHDGIEKVCGDFQDIERIHQFLSEQFLESEQKQQFSPSMTERKPLSQQERDSCISPSEPETKAEQKSNYFEVPLPYFEYFKYICPDKINSIEKRFGVNIEIQESSPNMVCLDFTSSRSGDLEAARESFASEFQKNTEPLKQECVSLADSKQANKFKQELNHQFTKLLIKEKGGELTLLGTQDDISAAKQKISEAFVKIPVKLFAANYMMNVIEVDSAHYKLLETELLQEISEIEKRYDICSKVSEKGQKTCILFESKDRQVDLSVHAYASFIDAFQHASCQLMREVLLLKSLGKERKHLHQTKFADDFRKRHPNVHFVLNQESMTLTGLPNHLAKAKQYVLKGGGMSSLAGKKLKEGHETPMDIDSDDSKAASPPLKGSVSSEASELDKKEKGICVICMDTISNKKVLPKCKHEFCAPCINKAMSYKPICPTCQTSYGIQKGNQPEGSMVFTVSRDSLPGYESFGTIVITYSMKAGIQTEEHPNPGKRYPGIQRTAYLPDNKEGRKVLKLLYRAFDQKLIFTVGYSRVLGVSDVITWNDIHHKTSRFGGPEMYGYPDPSYLKRVKEELKAKGIE

SEQ ID NO: 23730 - protein, 228 aa, Homo sapiens
  Payload ID: 4745
  Gene Symbol: DTX3L
  Gene Name: deltex 3 like, E3 ubiquitin ligase
  Uniprot ID: Q8TDB6
  ENSP ID: ENSP00000373157
MASHLRPPSPLLVRVYKSGPRVRRKLESYFQSSKSSGGGECTVSTQEHEAPGTFRVEFSERAAKERVLKKGEHQILVDEKPVPIFLVPTENSIKKNTRPQISSLTQSQAETPSGDMHQHEGHIPNAVDSCLQKEEHPNPGKRYPGIQRTAYLPDNKEGRKVLKLLYRAFDQKLIFTVGYSRVLGVSDVITWNDIHHKTSRFGGPEMYGYPDPSYLKRVKEELKAKGIE

SEQ ID NO: 23731 - protein, 347 aa, Homo sapiens
  Payload ID: 4746
  Gene Symbol: DTX3
  Gene Name: deltex 3, E3 ubiquitin ligase
  Uniprot ID: Q8N9I9
  ENSP ID: ENSP00000338050
MSFVLSRMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 23732 - protein, 172 aa, Homo sapiens
  Payload ID: 4746
  Gene Symbol: DTX3
  Gene Name: deltex 3, E3 ubiquitin ligase
  ENSP ID: ENSP00000446996
QPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLCDPSSFPFPWLLPFVPFPLRDPPTPRSRSLLTGENHFQTVQPSQFLLHSTWSWCAQLSLQK

SEQ ID NO: 23733 - protein, 347 aa, Homo sapiens; identical to SEQ ID NO: 23731
  Payload ID: 4746
  Gene Symbol: DTX3
  Gene Name: deltex 3, E3 ubiquitin ligase
  Uniprot ID: Q8N9I9
  ENSP ID: ENSP00000447873

SEQ ID NO: 23734 - protein, 194 aa, Homo sapiens
  Payload ID: 4746
  Gene Symbol: DTX3
  Gene Name: deltex 3, E3 ubiquitin ligase
  ENSP ID: ENSP00000448224
MAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPM

SEQ ID NO: 23735 - protein, 350 aa, Homo sapiens
  Payload ID: 4746
  Gene Symbol: DTX3
  Gene Name: deltex 3, E3 ubiquitin ligase
  Uniprot ID: Q8N9I9
  ENSP ID: ENSP00000448696
MPILSSSGSKMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 23736 - protein, 7 aa, Homo sapiens
  Payload ID: 4746
  Gene Symbol: DTX3
  Gene Name: deltex 3, E3 ubiquitin ligase
  ENSP ID: ENSP00000449118
MPILSSS

SEQ ID NO: 23737 - protein, 347 aa, Homo sapiens; identical to SEQ ID NO: 23731
  Payload ID: 4746
  Gene Symbol: DTX3
  Gene Name: deltex 3, E3 ubiquitin ligase
  Uniprot ID: Q8N9I9
  ENSP ID: ENSP00000449294

SEQ ID NO: 23738 - protein, 204 aa, Homo sapiens
  Payload ID: 4746
  Gene Symbol: DTX3
  Gene Name: deltex 3, E3 ubiquitin ligase
  ENSP ID: ENSP00000449688
MPILSSSGSKMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPM

SEQ ID NO: 23739 - protein, 48 aa, Homo sapiens
  Payload ID: 4746
  Gene Symbol: DTX3
  Gene Name: deltex 3, E3 ubiquitin ligase
  ENSP ID: ENSP00000449950
MSFVLSRMAACGGTCKNKVTVSKPVWDFLSKETPARLARLREEHRVSI

SEQ ID NO: 23740 - protein, 619 aa, Homo sapiens
  Payload ID: 4747
  Gene Symbol: DTX4
  Gene Name: deltex 4, E3 ubiquitin ligase
  Uniprot ID: Q9Y2E6
  ENSP ID: ENSP00000227451
MLLASAVVVWEWLNEHGRWRPYSPAVSHHIEAVVRAGPRAGGSVVLGQVDSRLAPYIIDLQSMNQFRQDTGTLRPVRRNYYDPSSAPGKGVVWEWENDNGSWTPYDMEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 23741 - protein, 513 aa, Homo sapiens
  Payload ID: 4747
  Gene Symbol: DTX4
  Gene Name: deltex 4, E3 ubiquitin ligase
  Uniprot ID: Q9Y2E6
  ENSP ID: ENSP00000434055
MEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 23742 - protein, 405 aa, Homo sapiens
  Payload ID: 4748
  Gene Symbol: DMTN
  Gene Name: dematin actin binding protein
  Uniprot ID: Q08495
  ENSP ID: ENSP00000265800
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 23743 - protein, 405 aa, Homo sapiens; identical to SEQ ID NO: 23742
  Payload ID: 4748
  Gene Symbol: DMTN
  Gene Name: dematin actin binding protein
  Uniprot ID: Q08495
  ENSP ID: ENSP00000350977

SEQ ID NO: 23744 - protein, 383 aa, Homo sapiens
  Payload ID: 4748
  Gene Symbol: DMTN
  Gene Name: dematin actin binding protein
  Uniprot ID: Q08495
  ENSP ID: ENSP00000370879
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQIYPYEMLVVTNKGRTKLPPGVDRMRLERHLSAEDFSRVFAMSPEEFGKLALWKRNELKKKASLF

SEQ ID NO: 23745 - protein, 358 aa, Homo sapiens
  Payload ID: 4748
  Gene Symbol: DMTN
  Gene Name: dematin actin binding protein
  Uniprot ID: Q08495
  ENSP ID: ENSP00000397904
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQIYPYEMLVVTNKGRTKLPPGVDRMRLERHLSAEDFSRVFAMSPEEFGKLALWKRNELKKKASLF

SEQ ID NO: 23746 - protein, 383 aa, Homo sapiens; identical to SEQ ID NO: 23744
  Payload ID: 4748
  Gene Symbol: DMTN
  Gene Name: dematin actin binding protein
  Uniprot ID: Q08495
  ENSP ID: ENSP00000401291

SEQ ID NO: 23747 - protein, 405 aa, Homo sapiens; identical to SEQ ID NO: 23742
  Payload ID: 4748
  Gene Symbol: DMTN
  Gene Name: dematin actin binding protein
  Uniprot ID: Q08495
  ENSP ID: ENSP00000416111

SEQ ID NO: 23748 - protein, 405 aa, Homo sapiens; identical to SEQ ID NO: 23742
  Payload ID: 4748
  Gene Symbol: DMTN
  Gene Name: dematin actin binding protein
  Uniprot ID: Q08495
  ENSP ID: ENSP00000427866

SEQ ID NO: 23749 - protein, 71 aa, Homo sapiens
  Payload ID: 4748
  Gene Symbol: DMTN
  Gene Name: dematin actin binding protein
  ENSP ID: ENSP00000428063
MERLQKAKMDNQVLGYKDLAAIPKDKAILDIERPDLMIYEPHFTYSLLEHVELPRSRERSLSPKSTSPPPS

SEQ ID NO: 23750 - protein, 201 aa, Homo sapiens
  Payload ID: 4748
  Gene Symbol: DMTN
  Gene Name: dematin actin binding protein
  ENSP ID: ENSP00000428415
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVV

SEQ ID NO: 23751 - protein, 148 aa, Homo sapiens
  Payload ID: 4748
  Gene Symbol: DMTN
  Gene Name: dematin actin binding protein
  ENSP ID: ENSP00000428733
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKF

SEQ ID NO: 23752 - protein, 162 aa, Homo sapiens
  Payload ID: 4748
  Gene Symbol: DMTN
  Gene Name: dematin actin binding protein
  ENSP ID: ENSP00000429116
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKI

SEQ ID NO: 23753 - protein, 358 aa, Homo sapiens; identical to SEQ ID NO: 23745
  Payload ID: 4748
  Gene Symbol: DMTN
  Gene Name: dematin actin binding protein
  Uniprot ID: Q08495
  ENSP ID: ENSP00000429234

SEQ ID NO: 23754 - protein, 383 aa, Homo sapiens; identical to SEQ ID NO: 23744
  Payload ID: 4748
  Gene Symbol: DMTN
  Gene Name: dematin actin binding protein
  Uniprot ID: Q08495
  ENSP ID: ENSP00000429377

SEQ ID NO: 23755 - protein, 201 aa, Homo sapiens; identical to SEQ ID NO: 23750
  Payload ID: 4748
  Gene Symbol: DMTN
  Gene Name: dematin actin binding protein
  ENSP ID: ENSP00000429948

SEQ ID NO: 23756 - protein, 218 aa, Homo sapiens
  Payload ID: 4748
  Gene Symbol: DMTN
  Gene Name: dematin actin binding protein
  ENSP ID: ENSP00000430382
MERLQKAKMDNQVLGYKDLAAIPKDKAILDIERPDLMIYEPHFTYSLLEHVELPRSRERSLSPKSTSPPPSPEVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSK

SEQ ID NO: 23757 - protein, 110 aa, Homo sapiens
  Payload ID: 4748
  Gene Symbol: DMTN
  Gene Name: dematin actin binding protein
  ENSP ID: ENSP00000430600
MERLQKQPLTSPGSVSPSRDSSVPGSPSSIVAKMDNQVLGYKDLAAIPKDKAILDIERPDLMIYEPHFTYSLLEHVELPRSRERSLSPKSTSPPPSPEVWADSRSPGIIS

SEQ ID NO: 23758 - protein, 405 aa, Homo sapiens; identical to SEQ ID NO: 23742
  Payload ID: 4748
  Gene Symbol: DMTN
  Gene Name: dematin actin binding protein
  Uniprot ID: Q08495
  ENSP ID: ENSP00000430609

SEQ ID NO: 23759 - protein, 365 aa, Homo sapiens
  Payload ID: 4748
  Gene Symbol: DMTN
  Gene Name: dematin actin binding protein
  Uniprot ID: Q08495
  ENSP ID: ENSP00000430618
MERLQKAKMDNQVLGYKDLAAIPKDKAILDIERPDLMIYEPHFTYSLLEHVELPRSREVWADSRSPGIISQASAPRTTGTPRTSLPHFHHPETSRPDSNIYKKPPIYKQRESVGGSPQTKHLIEDLIIESSKFPAAQPPDPNQPAKIETDYWPCPPSLAVVETEWRKRKASRRGAEEEEEEEDDDSGEEMKALRERQREELSKVTSNLGKMILKEEMEKSLPIRRKTRSLPDRTPFHTSLHQGTSKSSSLPAYGRTTLSRLQSTEFSPSGSETGSPGLQNGEGQRGRMDRGNSLPCVLEQKIYPYEMLVVTNKGRTKLPPGVDRMRLERHLSAEDFSRVFAMSPEEFGKLALWKRNELKKKASLF

SEQ ID NO: 23760 - protein, 71 aa, Homo sapiens
  Payload ID: 4748
  Gene Symbol: DMTN
  Gene Name: dematin actin binding protein
  ENSP ID: ENSP00000477684
MERLQKQPLTSPGSVSPSRDSSVPGSPSSIVAKMDNQVLGYKDLAAIPKDKAILDIERPDLMIYEPHFTYS

SEQ ID NO: 23761 - protein, 74 aa, Homo sapiens
  Payload ID: 4748
  Gene Symbol: DMTN
  Gene Name: dematin actin binding protein
  ENSP ID: ENSP00000478536
MERLQKAKMDNQVLGYKDLAAIPKDKAILDIERPDLMIYEPHFTYSLLEHVELPRSRERSLSPKSTSPPPSPEV

SEQ ID NO: 23762 - protein, 711 aa, Homo sapiens
  Payload ID: 4749
  Gene Symbol: DDN
  Gene Name: dendrin
  Uniprot ID: O94850
  ENSP ID: ENSP00000390590
MLDGPLFSEGPDSPRELQDEESGSCLWVQKSKLLVIEVKTISCHYSRRAPSRQPMDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVISQTEEVLFGVRDIRGTQQGNRKRQ

SEQ ID NO: 23763 - protein, 244 aa, Homo sapiens
  Payload ID: 4750
  Gene Symbol: DCANP1
  Gene Name: dendritic cell-associated nuclear protein
  Uniprot ID: Q8TF63
  ENSP ID: ENSP00000421871
MHYGAATHIQNSRSHGLETVPGHQRLERGAGGETPEFPGCHSPAPPENFGNELLPLSAPLQGLSEGLYPPGRNKTLPAGVLREGAVQFLHRGLCNSNLSSEASARPSGTQDELHSSRRKTGQTRREGARKHLVCSFRLYPFTVHTVSPGNSHLALYQVFKAVKLCPSETSFFLSRKSLKSSDPWHPPSLSPNSWNRQAGFRAWSSHLISLSLTCSDSQSRRVSSSQQPPLHSLSSHRRAAHVPE

SEQ ID NO: 23764 - protein, 470 aa, Homo sapiens
  Payload ID: 4751
  Gene Symbol: DCSTAMP
  Gene Name: dendrocyte expressed seven transmembrane protein
  Uniprot ID: Q9H295
  ENSP ID: ENSP00000297581
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKYVIIPTFWPTPKERKNLGLFFLPILIHLCIWVLFAAVDYLLYRLIFSVSKQFQSLPGFEVHLKLHGEKQGTQDIIHDSSFNISVFEPNCIPKPKFLLSETWVPLSVILLILVMLGLLSSILMQLKILVSASFYPSVERKRIQYLHAKLLKKRSKQPLGEVKRRLSLYLTKIHFWLPVLKMIRKKQMDMASADKS

SEQ ID NO: 23765 - protein, 283 aa, Homo sapiens
  Payload ID: 4751
  Gene Symbol: DCSTAMP
  Gene Name: dendrocyte expressed seven transmembrane protein
  Uniprot ID: Q9H295
  ENSP ID: ENSP00000428869
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKFISGFQS

SEQ ID NO: 23766 - protein, 283 aa, Homo sapiens; identical to SEQ ID NO: 23765
  Payload ID: 4751
  Gene Symbol: DCSTAMP
  Gene Name: dendrocyte expressed seven transmembrane protein
  Uniprot ID: Q9H295
  ENSP ID: ENSP00000480546

SEQ ID NO: 23767 - protein, 466 aa, Homo sapiens
  Payload ID: 4752
  Gene Symbol: DENND1A
  Gene Name: DENN/MADD domain containing 1A
  Uniprot ID: Q8TEH3
  ENSP ID: ENSP00000362720
MLKWPIPGQVALFQILRCRGNSRRTTVTSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQAL

SEQ ID NO: 23768 - protein, 559 aa, Homo sapiens
  Payload ID: 4752
  Gene Symbol: DENND1A
  Gene Name: DENN/MADD domain containing 1A
  Uniprot ID: Q8TEH3
  ENSP ID: ENSP00000362722
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 23769 - protein, 1009 aa, Homo sapiens
  Payload ID: 4752
  Gene Symbol: DENND1A
  Gene Name: DENN/MADD domain containing 1A
  Uniprot ID: Q8TEH3
  ENSP ID: ENSP00000362727
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 23770 - protein, 459 aa, Homo sapiens
  Payload ID: 4752
  Gene Symbol: DENND1A
  Gene Name: DENN/MADD domain containing 1A
  ENSP ID: ENSP00000377763
SYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 23771 - protein, 909 aa, Homo sapiens
  Payload ID: 4752
  Gene Symbol: DENND1A
  Gene Name: DENN/MADD domain containing 1A
  ENSP ID: ENSP00000377766
SYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 23772 - protein, 396 aa, Homo sapiens
  Payload ID: 4753
  Gene Symbol: DENND1B
  Gene Name: DENN/MADD domain containing 1B
  Uniprot ID: Q6P3S1
  ENSP ID: ENSP00000235453
MAAAPREEKRWPQPVFSNPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGKDKLQYDYPFSQ

SEQ ID NO: 23773 - protein, 352 aa, Homo sapiens
  Payload ID: 4753
  Gene Symbol: DENND1B
  Gene Name: DENN/MADD domain containing 1B
  ENSP ID: ENSP00000294737
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGTRGHINNGCIQSRKEVHCSTQQ

SEQ ID NO: 23774 - protein, 426 aa, Homo sapiens
  Payload ID: 4753
  Gene Symbol: DENND1B
  Gene Name: DENN/MADD domain containing 1B
  Uniprot ID: Q6P3S1
  ENSP ID: ENSP00000356366
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGKDKLQYDYPFSQ

SEQ ID NO: 23775 - protein, 415 aa, Homo sapiens
  Payload ID: 4753
  Gene Symbol: DENND1B
  Gene Name: DENN/MADD domain containing 1B
  ENSP ID: ENSP00000375839
VKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 23776 - protein, 147 aa, Homo sapiens
  Payload ID: 4753
  Gene Symbol: DENND1B
  Gene Name: DENN/MADD domain containing 1B
  ENSP ID: ENSP00000410025
MPLKMKEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNML

SEQ ID NO: 23777 - protein, 775 aa, Homo sapiens
  Payload ID: 4753
  Gene Symbol: DENND1B
  Gene Name: DENN/MADD domain containing 1B
  Uniprot ID: Q6P3S1
  ENSP ID: ENSP00000479816
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 23778 - protein, 801 aa, Homo sapiens
  Payload ID: 4754
  Gene Symbol: DENND1C
  Gene Name: DENN/MADD domain containing 1C
  Uniprot ID: Q8IV53
  ENSP ID: ENSP00000370889
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASSGALRSYQLWADNLKKGGGALLHSVKAKTQPAVKNMYRSAKSGLKGVQSLLMYKDGDSVLQRGGSLRAPALPSRSDRLQQRLPITQHFGKNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 23779 - protein, 757 aa, Homo sapiens
  Payload ID: 4754
  Gene Symbol: DENND1C
  Gene Name: DENN/MADD domain containing 1C
  Uniprot ID: Q8IV53
  ENSP ID: ENSP00000437805
MQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASSGALRSYQLWADNLKKGGGALLHSVKAKTQPAVKNMYRSAKSGLKGVQSLLMYKDGDSVLQRGGSLRAPALPSRSDRLQQRLPITQHFGKNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNIPRWQPDDKKLPEPEPQPLSLPSLQNASSLDATSSSKDSRSQLIPSESDQEVTSPSQSSTASADPSIWGDPKPSPLTEPLILHLTPSHKAAEDSTAQENPTPWLSTAPTEPSPPESPQILAPTKPNFDIAWTSQPLDPSSDPSSLEDPRARPPKALLAERAHLQPREEPGALNSPATPTSNCQKSQPSSRPRVADLKKCFEG

SEQ ID NO: 23780 - protein, 215 aa, Homo sapiens
  Payload ID: 4754
  Gene Symbol: DENND1C
  Gene Name: DENN/MADD domain containing 1C
  ENSP ID: ENSP00000465675
MQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYC

SEQ ID NO: 23781 - protein, 90 aa, Homo sapiens
  Payload ID: 4754
  Gene Symbol: DENND1C
  Gene Name: DENN/MADD domain containing 1C
  ENSP ID: ENSP00000466334
MESRAERIPPSCGSSLQTSGTRKLCRWCLNSASLLMWKGSPPAPPCSISPSPSQTLPATADLVSAACGRVPRAVSASSATCLGSRCFTSY

SEQ ID NO: 23782 - protein, 88 aa, Homo sapiens
  Payload ID: 4754
  Gene Symbol: DENND1C
  Gene Name: DENN/MADD domain containing 1C
  ENSP ID: ENSP00000466394
MQMVPKFCFPFDVEREPPSPAVQHFTFALTDLAGNRRFGFCRLRAGTQSCLCILSHLPWFEVFYKLLNTVGDLLAQDQVTEAEELLQN

SEQ ID NO: 23783 - protein, 127 aa, Homo sapiens
  Payload ID: 4754
  Gene Symbol: DENND1C
  Gene Name: DENN/MADD domain containing 1C
  ENSP ID: ENSP00000466583
MQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKP

SEQ ID NO: 23784 - protein, 141 aa, Homo sapiens
  Payload ID: 4754
  Gene Symbol: DENND1C
  Gene Name: DENN/MADD domain containing 1C
  ENSP ID: ENSP00000467008
MQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPS

SEQ ID NO: 23785 - protein, 1009 aa, Homo sapiens
  Payload ID: 4755
  Gene Symbol: DENND2A
  Gene Name: DENN/MADD domain containing 2A
  Uniprot ID: Q9ULE3
  ENSP ID: ENSP00000275884
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSILSKCCHAMVALIYPFAWQHTYIPVLPPAMVDIVCSPTPFLIGLLSSSLPLLRELPLEEVLVVDLVNSRFLRQMDDEDSILPRKLQVALEHILEQRNELACEQDEGPLDGRHGPESSPLNEVVSEAFVRFFVEIVGHYSLFLTSGEREERTLQREAFRKAVSSKSLRHFLEVFMETQMFRGFIQERELRRQDAKGLFEVRAQEYLETLPSGEHSGVNKFLKGLGNKMKFLHKK

SEQ ID NO: 23786 - protein, 864 aa, Homo sapiens
  Payload ID: 4755
  Gene Symbol: DENND2A
  Gene Name: DENN/MADD domain containing 2A
  ENSP ID: ENSP00000417673
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSTPTSRCCHPPWSTSCARRRPSSSGCSPARCHCSGSCRWKRSLWLTSSTAGSSDRWTMRTPSCPGSFRWPWNTFWNRGTSWLVSRTKGP

SEQ ID NO: 23787 - protein, 90 aa, Homo sapiens
  Payload ID: 4755
  Gene Symbol: DENND2A
  Gene Name: DENN/MADD domain containing 2A
  ENSP ID: ENSP00000418088
MDMFSLDMIISDPAAEASRAGKKQLRGVQNPCPSARARPRHKSLNIKDKISEWEGKKEVPTPAPSRRADGQEDYLPSSTVERRSSDGVRT

SEQ ID NO: 23788 - protein, 78 aa, Homo sapiens
  Payload ID: 4755
  Gene Symbol: DENND2A
  Gene Name: DENN/MADD domain containing 2A
  ENSP ID: ENSP00000418760
MDMFSLDMIISDPAAEASRAGKKQLRGVQNPCPSARARPRHKSLNIKDKISEWEGKKEVPTPAPSRRADGQEDYLPSS

SEQ ID NO: 23789 - protein, 157 aa, Homo sapiens
  Payload ID: 4755
  Gene Symbol: DENND2A
  Gene Name: DENN/MADD domain containing 2A
  ENSP ID: ENSP00000418844
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPL

SEQ ID NO: 23790 - protein, 795 aa, Homo sapiens
  Payload ID: 4755
  Gene Symbol: DENND2A
  Gene Name: DENN/MADD domain containing 2A
  Uniprot ID: Q9ULE3
  ENSP ID: ENSP00000419464
MDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDPLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLRYPPWLLLLKRLNDSRSWTL

SEQ ID NO: 23791 - protein, 1009 aa, Homo sapiens; identical to SEQ ID NO: 23785
  Payload ID: 4755
  Gene Symbol: DENND2A
  Gene Name: DENN/MADD domain containing 2A
  Uniprot ID: Q9ULE3
  ENSP ID: ENSP00000419654

SEQ ID NO: 23792 - protein, 163 aa, Homo sapiens
  Payload ID: 4755
  Gene Symbol: DENND2A
  Gene Name: DENN/MADD domain containing 2A
  ENSP ID: ENSP00000420145
PGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSTPTSRCCHPPWSTSCARRRPSSSGCSPARCHCSGSCRWKR

SEQ ID NO: 23793 - protein, 105 aa, Homo sapiens
  Payload ID: 4755
  Gene Symbol: DENND2A
  Gene Name: DENN/MADD domain containing 2A
  ENSP ID: ENSP00000420605
MKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPK

SEQ ID NO: 23794 - protein, 1009 aa, Homo sapiens; identical to SEQ ID NO: 23785
  Payload ID: 4755
  Gene Symbol: DENND2A
  Gene Name: DENN/MADD domain containing 2A
  Uniprot ID: Q9ULE3
  ENSP ID: ENSP00000442245

SEQ ID NO: 23795 - protein, 928 aa, Homo sapiens
  Payload ID: 4756
  Gene Symbol: DENND2C
  Gene Name: DENN/MADD domain containing 2C
  Uniprot ID: Q68D51
  ENSP ID: ENSP00000376955
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLPPKPQFLHRKTMEVKNSQAYLRSKLTKDTTLPVTLTEWKLFRAGEVANTKRKNLPRLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITVKSYLPGAGDESIELCRPLDSRLEHVDFKCLFKCLSVCHLIRVCASLLLERRVIFVANSLSTLSKCGHAVVATLYPFTWQHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 23796 - protein, 871 aa, Homo sapiens
  Payload ID: 4756
  Gene Symbol: DENND2C
  Gene Name: DENN/MADD domain containing 2C
  Uniprot ID: Q68D51
  ENSP ID: ENSP00000376957
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPEPKKYGGKIRGRSKRKSFEFEDIQHFRNRNSQTIREELGRNSGSALYYTQSEDNIYEDIIYPTKENPYEDIPVQPLPMWRSPSAWKLPPAKSAFKAPKLVLKIDDIFESKRGKKKVKLHSYTGKELPPTKGETSGNESDAEYLPKNRHKRLAQLQPSSKRNPHYQTLERDLIELQEQQLFELFVVVSLQKKPSGISYIPQVIQQFPGKDDHGYKQSKDMEERLKVIPKFCFPDSKDWMPTSELKSETFSFVLTGEDGSRWFGYCKKLLPVGKGKRLPEVYCMVSRLGCFNLFSKILDEVEKRREMSPALVYPFMRSVMEAPFPAPGRTITVKSYLPGAGDESIELCRPLDSRLEHVDFKCLFKCLSVCHLIRVCASLLLERRVIFVANSLSTLSKCGHAVVATLYPFTWQHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 23797 - protein, 928 aa, Homo sapiens; identical to SEQ ID NO: 23795
  Payload ID: 4756
  Gene Symbol: DENND2C
  Gene Name: DENN/MADD domain containing 2C
  Uniprot ID: Q68D51
  ENSP ID: ENSP00000376958

SEQ ID NO: 23798 - protein, 471 aa, Homo sapiens
  Payload ID: 4757
  Gene Symbol: DENND2D
  Gene Name: DENN/MADD domain containing 2D
  Uniprot ID: Q9H6A0
  ENSP ID: ENSP00000350266
MEGQVVGRVFRLFQRRLLQLRAGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 23799 - protein, 468 aa, Homo sapiens
  Payload ID: 4757
  Gene Symbol: DENND2D
  Gene Name: DENN/MADD domain containing 2D
  Uniprot ID: Q9H6A0
  ENSP ID: ENSP00000358767
MDGLGRRLRASLRLKRGHGGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 23800 - protein, 1198 aa, Homo sapiens
  Payload ID: 4758
  Gene Symbol: DENND3
  Gene Name: DENN/MADD domain containing 3
  Uniprot ID: A2RUS2
  ENSP ID: ENSP00000262585
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 23801 - protein, 1146 aa, Homo sapiens
  Payload ID: 4758
  Gene Symbol: DENND3
  Gene Name: DENN/MADD domain containing 3
  Uniprot ID: A2RUS2
  ENSP ID: ENSP00000410594
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 23802 - protein, 102 aa, Homo sapiens
  Payload ID: 4758
  Gene Symbol: DENND3
  Gene Name: DENN/MADD domain containing 3
  ENSP ID: ENSP00000428155
DEYCFYNGKTHRECPGCFVPFAVCVVSRFPYYNSLKDCLSWPRRKQLTTVPFCVIMLENEPRQIAELVLFLLLAKHSHLRPSALTRGTSPMESEQEPYCSNQ

SEQ ID NO: 23803 - protein, 1203 aa, Homo sapiens
  Payload ID: 4758
  Gene Symbol: DENND3
  Gene Name: DENN/MADD domain containing 3
  ENSP ID: ENSP00000428276
  MOD_RES (1)..(1): Any amino acid
XPRDSLRSLEQVAYKKGVKHLSALLDPEVLSIFVPPFISKEDSQMAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 23804 - protein, 67 aa, Homo sapiens
  Payload ID: 4758
  Gene Symbol: DENND3
  Gene Name: DENN/MADD domain containing 3
  ENSP ID: ENSP00000428641
MAEAASPHLSLPSGLLELCALLGAPRDSLRSLEQRSCPFSCLLLSVKRTVKWPVPTAALSVKPGCAP

SEQ ID NO: 23805 - protein, 1278 aa, Homo sapiens
  Payload ID: 4758
  Gene Symbol: DENND3
  Gene Name: DENN/MADD domain containing 3
  ENSP ID: ENSP00000428714
MAEAASPHLSLPSGLLELCALLGAPRDSLRSLEQVAYKKGVKHLSALLDPEVLSIFVPPFISKEDSQMAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 23806 - protein, 122 aa, Homo sapiens
  Payload ID: 4758
  Gene Symbol: DENND3
  Gene Name: DENN/MADD domain containing 3
  ENSP ID: ENSP00000429533
VGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVVSTRSVRKEASEFT

SEQ ID NO: 23807 - protein, 170 aa, Homo sapiens
  Payload ID: 4758
  Gene Symbol: DENND3
  Gene Name: DENN/MADD domain containing 3
  ENSP ID: ENSP00000429725
  MOD_RES (1)..(1): Any amino acid
XTGNSIMVMKMNGSLHQELKIEENFKDTSTSFLAFQLLPEEEQLWAACAGRSEVYIWSLKDLAQPPQRVPLEDCSEINCMIRVKKQVGWRARHPQHPRQVSLALAASPCSREPAARPRALLPSPLRVPLLTGTCRVGANGPTGHHVLVSWCGPSTPQRIPPNWMASNDRT

SEQ ID NO: 23808 - protein, 280 aa, Homo sapiens
  Payload ID: 4758
  Gene Symbol: DENND3
  Gene Name: DENN/MADD domain containing 3
  ENSP ID: ENSP00000429780
MAEAASPHLSLPSGLLELCALLGAPRDSLRSLEQVAYKKGVKHLSALLDPEVLSIFVPPFISKEDSQMAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSK

SEQ ID NO: 23809 - protein, 124 aa, Homo sapiens
  Payload ID: 4758
  Gene Symbol: DENND3
  Gene Name: DENN/MADD domain containing 3
  ENSP ID: ENSP00000430625
MAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVC

SEQ ID NO: 23810 - protein, 208 aa, Homo sapiens
  Payload ID: 4758
  Gene Symbol: DENND3
  Gene Name: DENN/MADD domain containing 3
  ENSP ID: ENSP00000430695
MAEAASPHLSLPSGLLELCALLGAPRDSLRSLEQVAYKKGVKHLSALLDPEVLSIFVPPFISKEDSQMAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSW

SEQ ID NO: 23811 - protein, 291 aa, Homo sapiens
  Payload ID: 4758
  Gene Symbol: DENND3
  Gene Name: DENN/MADD domain containing 3
  ENSP ID: ENSP00000430786
MAEAASPHLSLPSGLLELCALLGAPRDSLRSLEQVAYKKGVKHLSALLDPEVLSIFVPPFISKEDSQMAGANCGTLGKTRMRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVQPCLSSHSVNTEFELKCDFKVFNMKSLQIVLPARADPESPILDLD

SEQ ID NO: 23812 - protein, 248 aa, Homo sapiens
  Payload ID: 4758
  Gene Symbol: DENND3
  Gene Name: DENN/MADD domain containing 3
  ENSP ID: ENSP00000430912
MVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 23813 - protein, 1906 aa, Homo sapiens
  Payload ID: 4759
  Gene Symbol: DENND4A
  Gene Name: DENN/MADD domain containing 4A
  Uniprot ID: Q7Z401
  ENSP ID: ENSP00000391167
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSDGSDLDAVSHGSMDSGHGTHTVEQAPFNTGLIKVYATDDRSSTGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPIFPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 23814 - protein, 1863 aa, Homo sapiens
  Payload ID: 4759
  Gene Symbol: DENND4A
  Gene Name: DENN/MADD domain containing 4A
  Uniprot ID: Q7Z401
  ENSP ID: ENSP00000396830
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPIFPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 23815 - protein, 26 aa, Homo sapiens
  Payload ID: 4759
  Gene Symbol: DENND4A
  Gene Name: DENN/MADD domain containing 4A
  ENSP ID: ENSP00000456605
  MOD_RES (1)..(1): Any amino acid
XSTHNCDRPPSTGVMECRKTFGEPYL

SEQ ID NO: 23816 - protein, 1001 aa, Homo sapiens
  Payload ID: 4759
  Gene Symbol: DENND4A
  Gene Name: DENN/MADD domain containing 4A
  ENSP ID: ENSP00000457358
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNET

SEQ ID NO: 23817 - protein, 1916 aa, Homo sapiens
  Payload ID: 4759
  Gene Symbol: DENND4A
  Gene Name: DENN/MADD domain containing 4A
  ENSP ID: ENSP00000489304
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSADGSDLDAVSHGSMDSGHGTHTVEQAPFNTGLIKVYATDDRSSTGGQSDLGYNSLSKDEVRRGDTSTEDIQEEKDKKGSDCSSLSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPIFPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHSQSRTLLFETQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 23818 - protein, 1496 aa, Homo sapiens
  Payload ID: 4760
  Gene Symbol: DENND4B
  Gene Name: DENN/MADD domain containing 4B
  Uniprot ID: O75064
  ENSP ID: ENSP00000354597
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 23819 - protein, 1218 aa, Homo sapiens
  Payload ID: 4760
  Gene Symbol: DENND4B
  Gene Name: DENN/MADD domain containing 4B
  ENSP ID: ENSP00000357635
MEADAVSEGGAMAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRP

SEQ ID NO: 23820 - protein, 181 aa, Homo sapiens
  Payload ID: 4760
  Gene Symbol: DENND4B
  Gene Name: DENN/MADD domain containing 4B
  ENSP ID: ENSP00000435709
  MOD_RES (1)..(1): Any amino acid
XGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAGVWCRPAVLRGVPKGQAIRATGTGTGPAERRGAGSGTGGQSCAQPACHRCAVPLACLPCLPR

SEQ ID NO: 23821 - protein, 696 aa, Homo sapiens
  Payload ID: 4761
  Gene Symbol: DENND4C
  Gene Name: DENN/MADD domain containing 4C
  ENSP ID: ENSP00000354301
GKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 23822 - protein, 353 aa, Homo sapiens
  Payload ID: 4761
  Gene Symbol: DENND4C
  Gene Name: DENN/MADD domain containing 4C
  ENSP ID: ENSP00000369789
  MOD_RES (1)..(1): Any amino acid
XALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPRYQRVQRPLYVVINGVPL

SEQ ID NO: 23823 - protein, 881 aa, Homo sapiens
  Payload ID: 4761
  Gene Symbol: DENND4C
  Gene Name: DENN/MADD domain containing 4C
  ENSP ID: ENSP00000369792
  MOD_RES (1)..(1): Any amino acid
XQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRGI

SEQ ID NO: 23824 - protein, 378 aa, Homo sapiens
  Payload ID: 4761
  Gene Symbol: DENND4C
  Gene Name: DENN/MADD domain containing 4C
  ENSP ID: ENSP00000473273
  MOD_RES (1)..(1): Any amino acid
XDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAMIFPFQWQCPYIPLCPLSLAAVLSAPLPFIVGVDSRYFDLHDPPQDVVCIDLDTNMLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQVVS

SEQ ID NO: 23825 - protein, 1958 aa, Homo sapiens
  Payload ID: 4761
  Gene Symbol: DENND4C
  Gene Name: DENN/MADD domain containing 4C
  ENSP ID: ENSP00000473469
MIEDKGPRVTDYFVVAGLTDTSTLLDQEINRLDTKSTGPKAPITDIAIIIKSAGETVPEGYTCVEATPSALQANLNYGSLKSPELFLCYKRGRDKPPLTDIGVLYEGKERLIPGCEVILATPYGRCANVNNSSTTSQRIFITYRRAPPVRPQNSLAVTDICVIVTSKGETPPHTFCKVDKNLNCGMWGSSVFLCYKKSVPASNAIAYKAGLIFRYPEEDYESFPLSESDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAMIFPFQWQCPYIPLCPLSLAAVLSAPLPFIVGVDSRYFDLHDPPQDVVCIDLDTNMLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQGFLKSRDRAYAKFYTLLSKTQIFIRFIEECSFVSDKDTGLAFFDDCIEKLFPDKGTEKTDKVDFDSAEDTRLIELDDSQKSEHTVFIMPPEPPPDDGKDLSPKYSYKYFPRLDLKLFDRPQELKLCFSRHPTGNSITKSPPLMAKRTKQEIKTAHKLAKRCYTNPPQWAKCLFSHCYSLWFICLPAYVRVSHPKVRALQQAYDVLIKMRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISALQNVTGGSDGDTVSHGSVDSSNDANNGEHTVFVRDLIRLESIDNHSSTGGQSDQGYGSKDELIKDDAEIHVPEEQAARELITKTKMQTEEVCDASAIVAKHSQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 23826 - protein, 1909 aa, Homo sapiens
  Payload ID: 4761
  Gene Symbol: DENND4C
  Gene Name: DENN/MADD domain containing 4C
  ENSP ID: ENSP00000473565
MIEDKGPRVTDYFVVAGLTDTSTLLDQEINRLDTKSTGPKAPITDIAIIIKSAGETVPEGYTCVEATPSALQANLNYGSLKSPELFLCYKRGRDKPPLTDIGVLYEGKERLIPGCEVILATPYGRCANVNNSSTTSQRIFITYRRAPPVRPQNSLAVTDICVIVTSKGETPPHTFCKVDKNLNCGMWGSSVFLCYKKSVPASNAIAYKAGLIFRYPEEDYESFPLSESDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAMIFPFQWQCPYIPLCPLSLAAVLSAPLPFIVGVDSRYFDLHDPPQDVVCIDLDTNMLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQGFLKSRDRAYAKFYTLLSKTQIFIRFIEECSFVSDKDTGLAFFDDCIEKLFPDKGTEKTDKVDFDSAEDTRLIELDDSQKSEHTVFIMPPEPPPDDGKDLSPKYSYKYFPRLDLKLFDRPQELKLCFSRHPTGNSITKSPPLMAKRTKQEIKTAHKLAKRCYTNPPQWAKCLFSHCYSLWFICLPAYVRVSHPKVRALQQAYDVLIKMRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISGGQSDQGYGSKDELIKDDAEIHVPEEQAARELITKTKMQTEEVCDASAIVAKHSQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 23827 - protein, 1287 aa, Homo sapiens
  Payload ID: 4762
  Gene Symbol: DENND5A
  Gene Name: DENN/MADD domain containing 5A
  Uniprot ID: Q6IQ26
  ENSP ID: ENSP00000328524
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 23828 - protein, 189 aa, Homo sapiens
  Payload ID: 4762
  Gene Symbol: DENND5A
  Gene Name: DENN/MADD domain containing 5A
  ENSP ID: ENSP00000432428
  MOD_RES (1)..(1): Any amino acid
XQDNRQRKLTSGSLSTSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNS

SEQ ID NO: 23829 - protein, 261 aa, Homo sapiens
  Payload ID: 4762
  Gene Symbol: DENND5A
  Gene Name: DENN/MADD domain containing 5A
  ENSP ID: ENSP00000433483
  MOD_RES (1)..(1): Any amino acid
XIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLV

SEQ ID NO: 23830 - protein, 69 aa, Homo sapiens
  Payload ID: 4762
  Gene Symbol: DENND5A
  Gene Name: DENN/MADD domain containing 5A
  ENSP ID: ENSP00000433925
MSGGGGGGGSAPSRFADYFVICGLDTETGLEPDELSALCQYIQASKARDGASPFISSTTEEIIEMHSLF

SEQ ID NO: 23831 - protein, 186 aa, Homo sapiens
  Payload ID: 4762
  Gene Symbol: DENND5A
  Gene Name: DENN/MADD domain containing 5A
  ENSP ID: ENSP00000434237
  MOD_RES (1)..(1): Any amino acid
XGHAGPRRCSSPPVSSGGLLPSHPTTSPRGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 23832 - protein, 104 aa, Homo sapiens
  Payload ID: 4762
  Gene Symbol: DENND5A
  Gene Name: DENN/MADD domain containing 5A
  ENSP ID: ENSP00000434397
PSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAGQNHII

SEQ ID NO: 23833 - protein, 63 aa, Homo sapiens
  Payload ID: 4762
  Gene Symbol: DENND5A
  Gene Name: DENN/MADD domain containing 5A
  ENSP ID: ENSP00000435038
  MOD_RES (1)..(1): Any amino acid
XGKARAWVRLSMEKKLLSRHLKQLLSDHELTNDPVPHSDRTKQEAGGLHVHCQPMDLYIRRIG

SEQ ID NO: 23834 - protein, 195 aa, Homo sapiens
  Payload ID: 4762
  Gene Symbol: DENND5A
  Gene Name: DENN/MADD domain containing 5A
  ENSP ID: ENSP00000435368
  MOD_RES (1)..(1): Any amino acid
XEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARVIMKIKSLMSVPAHAECYVRDHLLHHWIALLADCPITAHMYEDVALIKDHTLVNSLIRVLQTLQEFNITLETSLVKGIDI

SEQ ID NO: 23835 - protein, 1241 aa, Homo sapiens
  Payload ID: 4762
  Gene Symbol: DENND5A
  Gene Name: DENN/MADD domain containing 5A
  Uniprot ID: Q6IQ26
  ENSP ID: ENSP00000435866
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDEITSYTTGLPCWLTAPSLHTCMRMWH

SEQ ID NO: 23836 - protein, 807 aa, Homo sapiens
  Payload ID: 4762
  Gene Symbol: DENND5A
  Gene Name: DENN/MADD domain containing 5A
  ENSP ID: ENSP00000436780
MSGGGGGGGSAPSRFADYFVICGLDTETGLEPDELSGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQEYFLIQNVGSLMPAHSCLP

SEQ ID NO: 23837 - protein, 738 aa, Homo sapiens
  Payload ID: 4763
  Gene Symbol: DENND5B
  Gene Name: DENN/MADD domain containing 5B
  Uniprot ID: Q6ZUT9
  ENSP ID: ENSP00000346238
MSGSCAAPGPGSGSSPAACRFAHYFVLCGIDADSGLEPDELAVLYQWLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREVCGLPSWGASQQAP

SEQ ID NO: 23838 - protein, 1274 aa, Homo sapiens
  Payload ID: 4763
  Gene Symbol: DENND5B
  Gene Name: DENN/MADD domain containing 5B
  Uniprot ID: Q6ZUT9
  ENSP ID: ENSP00000373734
MSGSCAAPGPGSGSSPAACRFAHYFVLCGIDADSGLEPDELAGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREKYMQEARSLGKNLRQPKLSDLSPAVIAQTNCKFVEGLLKECRMKTKRMLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFECQNLGKLTTVQIGHDNSGLLAKWLVDCVMVRNEITGHTYRFPCGRWLGKGIDDGSLERILIGELMTSASDEDLVKQCRTPPQQKSPTTARRLSITSLTGKNNKPNAGQIQEGIGEAVNNIVKHFHKPEKERGSLTVLLCGENGLVAALEQVFHHGFKSARIFHKNVFIWDFIEKVVAYFETTDQILDNEDDVLIQKSSCKTFCHYVNAINTAPRNIGKDGKFQILVCLGTRDRLLPQWIPLLAECPAITRMYEESALLRDRMTVNSLIRILQTIQDFTIVLEGSLIKGVDV

SEQ ID NO: 23839 - protein, 537 aa, Homo sapiens
  Payload ID: 4763
  Gene Symbol: DENND5B
  Gene Name: DENN/MADD domain containing 5B
  ENSP ID: ENSP00000442938
SPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKVKRTIVFLLWLLVALLLILTFLNFLFFCAYAYPYIIDFVNLF

SEQ ID NO: 23840 - protein, 1309 aa, Homo sapiens
  Payload ID: 4763
  Gene Symbol: DENND5B
  Gene Name: DENN/MADD domain containing 5B
  ENSP ID: ENSP00000444889
MGTHHHAQLIFVFLVEMRFHHVDQAGLELLTSSNSPASASRSAEITVVSQHAQPGFLYQWLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREKYMQEARSLGKNLRQPKLSDLSPAVIAQTNCKFVEGLLKECRMKTKRMLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFECQNLGKLTTVQIGHDNSGLLAKWLVDCVMVRNEITGHTYRFPCGRWLGKGIDDGSLERILIGELMTSASDEDLVKQCRTPPQQKSPTTARRLSITSLTGKNNKPNAGQIQEGIGEAVNNIVKHFHKPEKERGSLTVLLCGENGLVAALEQVFHHGFKSARIFHKNVFIWDFIEKVVAYFETTDQILDNEDDVLIQKSSCKTFCHYVNAINTAPRNIGKDGKFQILVCLGTRDRLLPQWIPLLAECPAITRMYEESALLRDRMTVNSLIRILQTIQDFTIVLEGSLIKGVDV

SEQ ID NO: 23841 - protein, 63 aa, Homo sapiens
  Payload ID: 4763
  Gene Symbol: DENND5B
  Gene Name: DENN/MADD domain containing 5B
  ENSP ID: ENSP00000445113
MSGSCAAPGPGSGSSPAACRFAHYFVLCGIDADSGLEPDELAEIRGQPSFFCVKISSFPSTID

SEQ ID NO: 23842 - protein, 1309 aa, Homo sapiens; identical to SEQ ID NO: 23840
  Payload ID: 4763
  Gene Symbol: DENND5B
  Gene Name: DENN/MADD domain containing 5B
  ENSP ID: ENSP00000486530

SEQ ID NO: 23843 - protein, 608 aa, Homo sapiens
  Payload ID: 4764
  Gene Symbol: DENND6A
  Gene Name: DENN/MADD domain containing 6A
  Uniprot ID: Q8IWF6
  ENSP ID: ENSP00000311401
MALRGPAGLGPGSRRPLDEAVAGAEGREAPALVAAGGAPEDDEEDDGRGRGLLRWDSFSAWLHCVCVVGFDLELGQAVEVIYPQHSKLTDREKTNICYLSFPDSNSGCLGDTQFCFRFRQSSGRRVSLHCLLDQFDKDLPVYLKKDPAYFYGYVYFRQVRDKTLKRGYFQKSLVLISKLPYIHFFHTVLKQIAPEYFEKNEPYLEAACNDVDRWPAPVPGKTLHLPIMGVVMKVRIPTCHDKPGTTQIVQLTQQVDTNISVILPTVHEVDIFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPTGEIPKQVKVKKLKNLKTLDSKPGVYTSYKPYLNRDEEIIKQLQKGVQQKRPSEAQSVILRRYFLELTQSFIIPLERYVASLMPLQKSISPWKSPPQLRQFLPEEFMKTLEKTGPQLTSRIKGDWIGLYRHFLKSPNFDGWFKTRRKEMTQKLEALHLEALCEEDLLLWIQKHTEVETVDLVLKLKNKLLQADREHLPVKPDTMEKLRTHIDAIILALPEDLQGILLKTGMT

SEQ ID NO: 23844 - protein, 168 aa, Homo sapiens
  Payload ID: 4764
  Gene Symbol: DENND6A
  Gene Name: DENN/MADD domain containing 6A
  ENSP ID: ENSP00000419334
  MOD_RES (1)..(1): Any amino acid
XDRWPAPVPGKTLHLPIMGVVMKVDTNISVILPTVHEVDIFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPTGEIPKQVKVKKLKNLKTLDSKP

SEQ ID NO: 23845 - protein, 125 aa, Homo sapiens
  Payload ID: 4764
  Gene Symbol: DENND6A
  Gene Name: DENN/MADD domain containing 6A
  ENSP ID: ENSP00000419570
  MOD_RES (1)..(1): Any amino acid
XEAQSVILRRYFLELTQSFIIPLERYVASLMPLQKSISPWKSPPQLRQFLPEEFMKTLEKTGPQLTSRIKGDWIGLYRHFLKSPNFDGWFKTRRKEMTQKLEALHLEALCEEVRKLCVCVMINNC

SEQ ID NO: 23846 - protein, 585 aa, Homo sapiens
  Payload ID: 4765
  Gene Symbol: DENND6B
  Gene Name: DENN/MADD domain containing 6B
  Uniprot ID: Q8NEG7
  ENSP ID: ENSP00000391524
MDALLGTGPRRARGCLGAAGPTSSGRAARTPAAPWARFSAWLECVCVVTFDLELGQALELVYPNDFRLTDKEKSSICYLSFPDSHSGCLGDTQFSFRMRQCGGQRSPWHADDRHYNSRAPVALQREPAHYFGYVYFRQVKDSSVKRGYFQKSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSSEMVLALTSCLQPLRFCCDFRPYFTIHDSEFKEFTTRTQAPPNVVLGVTNPFFIKTLQHWPHILRVGEPKMSGDLPKQVKLKKPSRLKTLDTKPGLYTAYTAHLHRDKALLKRLLKGVQKKRPSDVQSALLRRHLLELTQSFIIPLEHYMASLMPLQKSITPWKTPPQIQPFSQDDFLRSLEHAGPQLTCILKGDWLGLYRRFFKSPHFDGWYRQRHKEMALKLEALHLEAICEANIETWMKDKSEVEVVDLVLKLREKLVRAQGHQLPVKEATLQRAQLYIETVIGSLPKDLQAVLCPP

SEQ ID NO: 23847 - protein, 298 aa, Homo sapiens
  Payload ID: 4765
  Gene Symbol: DENND6B
  Gene Name: DENN/MADD domain containing 6B
  ENSP ID: ENSP00000414072
MLSRGVASSDRWCHQALCLPLQLVYPNDFRLTDKEKSSICYLSFPDSHSGCLGDTQFSFRMRQCGGQRSPWHADDRHYNSRAPVALQREPAHYFGYVYFRQVKDSSVKRGYFQKALGSSPTGRHPGSSVLGFLLSNNSGVQVRRSWGSCPVKLVGRATLGQLQSLVLVSRLPFVRLFQALLSLIAPEYFDKLAPCLEAVCSEIDQWPAPAPGQTLNLPVMGVVVQVRIPSRVDKSESSPPKQFDQENLLPAPVVLASVHELDLFRCFRPVLTHMQTLWELMLLGEPLLVLAPSPDVSS

SEQ ID NO: 23848 - protein, 198 aa, Homo sapiens
  Payload ID: 4766
  Gene Symbol: DENR
  Gene Name: density-regulated protein
  Uniprot ID: O43583
  ENSP ID: ENSP00000280557
MAADISESSGADCKGDPRNSAKLDADYPLRVLYCGVCSLPTEYCEYMPDVAKCRQWLEKNFPNEFAKLTVENSPKQEAGISEGQGTAGEEEEKKKQKRGGRGQIKQKKKTVPQKVTIAKIPRAKKKYVTRVCGLATFEIDLKEAQRFFAQKFSCGASVTGEDEIIIQGDFTDDIIDVIQEKWPEVDDDSIEDLGEVKK

SEQ ID NO: 23849 - protein, 160 aa, Homo sapiens
  Payload ID: 4766
  Gene Symbol: DENR
  Gene Name: density-regulated protein
  ENSP ID: ENSP00000413661
MAADISESSGADCKGDPRNSAKLDADYPLRVLYCGVCSLPTEYCEYMPDVAKCRQWLEKNFPNEFAKLTVENSPKQEAGISEGQGTAGEEEEKKKQKRGGRGQIKQKKKTVPQKVTIAKIPRAKKKYVTRVCGLATFEIDLKEAQRFFAQKFSCGASPPK

SEQ ID NO: 23850 - protein, 730 aa, Homo sapiens
  Payload ID: 4767
  Gene Symbol: DTL
  Gene Name: denticleless E3 ubiquitin protein ligase homolog (Drosophila)
  Uniprot ID: Q9NZJ0
  ENSP ID: ENSP00000355958
MLFNSVLRQPQLGVLRNGWSSQYPLQSLLTGYQCSGNDEHTSYGETGVPVPPFGCTFSSAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 23851 - protein, 688 aa, Homo sapiens
  Payload ID: 4767
  Gene Symbol: DTL
  Gene Name: denticleless E3 ubiquitin protein ligase homolog (Drosophila)
  ENSP ID: ENSP00000443870
MLFNSVLRQPQLGVLRNAPNMEHVLAVANEEGFVRLYNTESQSFRKKCFKEWMAHWNAVFDLAWVPGELKLVTAAGDQTAKFWDVKAGELIGTCKGHQCSLKSVAFSKFEKAVFCTGGRDGNIMVWDTRCNKKDGFYRQVNQISGAHNTSDKQTPSKPKKKQNSKGLAPSVDFQQSVTVVLFQDENTLVSAGAVDGIIKVWDLRKNYTAYRQEPIASKSFLYPGSSTRKLGYSSLILDSTGSTLFANCTDDNIYMFNMTGLKTSPVAIFNGHQNSTFYVKSSLSPDDQFLVSGSSDEAAYIWKVSTPWQPPTVLLGHSQEVTSVCWCPSDFTKIATCSDDNTLKIWRLNRGLEEKPGGDKLSTVGWASQKKKESRPGLVTVTSSQSTPAKAPRAKCNPSNSSPSSAACAPSCAGDLPLPSNTPTFSIKTSPAKARSPINRRGSVSSVSPKPPSSFKMSIRNWVTRTPSSSPPITPPASETKIMSPRKALIPVSQKSSQAEACSESRNRVKRRLDSSCLESVKQKCVKSCNCVTELDGQVENLHLDLCCLAGNQEDLSKDSLGPTKSSKIEGAGTSISEPPSPISPYASESCGTLPLPLRPCGEGSEMVGKENSSPENKNWLLAMAAKRKAENPSPRSPSSQTPNSRRQSGKKLPSPVTITPSSMRKICTYFHRKSQEDFCGPEHSTEL

SEQ ID NO: 23852 - protein, 497 aa, Homo sapiens
  Payload ID: 4768
  Gene Symbol: DMP1
  Gene Name: dentin matrix acidic phosphoprotein 1
  Uniprot ID: Q13316
  ENSP ID: ENSP00000282479
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 23853 - protein, 513 aa, Homo sapiens
  Payload ID: 4768
  Gene Symbol: DMP1
  Gene Name: dentin matrix acidic phosphoprotein 1
  Uniprot ID: Q13316
  ENSP ID: ENSP00000340935
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 23854 - protein, 1301 aa, Homo sapiens
  Payload ID: 4769
  Gene Symbol: DSPP
  Gene Name: dentin sialophosphoprotein
  Uniprot ID: Q9NZW4
  ENSP ID: ENSP00000282478
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSNSSDSSDSSDSSDSSDSSDSSDSSDSSNSSDSSDSSDSSDSSDSSDSSDSSDSSESSDSSDSSNSSDSSDSSDSSDSSDSSDSSDSSDSSDSSNSSDSSDSSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 23855 - protein, 1301 aa, Homo sapiens; identical to SEQ ID NO: 23854
  Payload ID: 4769
  Gene Symbol: DSPP
  Gene Name: dentin sialophosphoprotein
  Uniprot ID: Q9NZW4
  ENSP ID: ENSP00000382213

SEQ ID NO: 23856 - protein, 260 aa, Homo sapiens [sequence omitted]

SEQ ID NO: 23857 - protein, 317 aa, Homo sapiens
  Payload ID: 4770
  Gene Symbol: DCK
  Gene Name: deoxycytidine kinase
  ENSP ID: ENSP00000421508
MATPPKRSCPSFSASSEGTRIKKISIEGNIAAGKSTFVNILKQLCEDWEVVPEPVARWCNVQSTQDEFEELTMSQKNGGNVLQMMYEKPERWSFTFQTYACLSRIRAQLASLNGKLKDAEKPVLFFERSVYSDRYIFASNLYESECMNETEWTIYQDWHDWMNNQFGQSLELDGIIYLQATPETCLHRIYLRGRNEEQGIPLEYLEKLHYKHESWLLHRTLKTNFDYLQEVPILTLDVNEDFKDKYESLVEKSCSVAQAGVQWHNLGSLPSPPPRFNQFCLSLLSQRVFEYFVILLKTTGSQMVPDTSALCIFVTSY

SEQ ID NO: 23858 - protein, 15 aa, Homo sapiens
  Payload ID: 4770
  Gene Symbol: DCK
  Gene Name: deoxycytidine kinase
  ENSP ID: ENSP00000422971
MATPPKRSCPSFSAS

SEQ ID NO: 23859 - protein, 199 aa, Homo sapiens
  Payload ID: 4770
  Gene Symbol: DCK
  Gene Name: deoxycytidine kinase
  ENSP ID: ENSP00000425578
MATPPKRSCPSFSASSEGTRIKKISIEGNIAAGKSTFVNILKQLCEDWEVVPEPVARWCNVQSTQDEFEELTMSQKNGGNVLQMMYEKPERWSFTFQTYACLSRIRAQLASLNGKLKDAEKPVLFFERSVYSDRYIFASNLYESECMNETEWTIYQDWHDWMNNQFGQSLELDGIIYLQATPENQLRLSSRGAYLNTGC

SEQ ID NO: 23860 - protein, 48 aa, Homo sapiens
  Payload ID: 4770
  Gene Symbol: DCK
  Gene Name: deoxycytidine kinase
  ENSP ID: ENSP00000426389
MATPPKRSCPSFSASSEGTRIKKISIEGNIGKEPPEMWDARLGCRGSG

SEQ ID NO: 23861 - protein, 277 aa, Homo sapiens
  Payload ID: 4771
  Gene Symbol: DGUOK
  Gene Name: deoxyguanosine kinase
  Uniprot ID: Q16854
  ENSP ID: ENSP00000264093
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 23862 - protein, 189 aa, Homo sapiens
  Payload ID: 4771
  Gene Symbol: DGUOK
  Gene Name: deoxyguanosine kinase
  Uniprot ID: Q16854
  ENSP ID: ENSP00000306964
MAAGRLFLSRLRAPFSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRLHFEALMNIPVLVLDVNDDFSEEVTKQEDLMREVNTFVKNL

SEQ ID NO: 23863 - protein, 89 aa, Homo sapiens
  Payload ID: 4771
  Gene Symbol: DGUOK
  Gene Name: deoxyguanosine kinase
  Uniprot ID: Q16854
  ENSP ID: ENSP00000408209
MAAGRLFLSRLRAPFSSMAKSPLEGVSSSRGLHAGRGPRRLSIEGNIGLHCPKSWKLAGYDVPGASTMVLHIPDIFLFEPPESTAGALP

SEQ ID NO: 23864 - protein, 89 aa, Homo sapiens; identical to SEQ ID NO: 23863
  Payload ID: 4771
  Gene Symbol: DGUOK
  Gene Name: deoxyguanosine kinase
  Uniprot ID: Q16854
  ENSP ID: ENSP00000487122

SEQ ID NO: 23865 - protein, 302 aa, Homo sapiens
  Payload ID: 4772
  Gene Symbol: DOHH
  Gene Name: deoxyhypusine hydroxylase/monooxygenase
  Uniprot ID: Q9BU89
  ENSP ID: ENSP00000250937
MVTEQEVDAIGQTLVDPKQPLQARFRALFTLRGLGGPGAIAWISQAFDDDSALLKHELAYCLGQMQDARAIPMLVDVLQDTRQEPMVRHEAGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGLHCGSALFRHEVGYVLGQLQHEAAVPQLAAALARCTENPMVRHECAEALGAIARPACLAALQAHADDPERVVRESCEVALDMYEHETGRAFQYADGLEQLRGAPS

SEQ ID NO: 23866 - protein, 302 aa, Homo sapiens; identical to SEQ ID NO: 23865
  Payload ID: 4772
  Gene Symbol: DOHH
  Gene Name: deoxyhypusine hydroxylase/monooxygenase
  Uniprot ID: Q9BU89
  ENSP ID: ENSP00000398882

SEQ ID NO: 23867 - protein, 223 aa, Homo sapiens
  Payload ID: 4772
  Gene Symbol: DOHH
  Gene Name: deoxyhypusine hydroxylase/monooxygenase
  ENSP ID: ENSP00000464905
MVTEQEVDAIGQTLVDPKQPLQARFRALFTLRGLGGPGAIAWISQAFDDDSALLKHELAYCLGQMQDARAIPMLVDVLQDTRQEPMVRHEAGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGLHCGSALFRHEVGYVLGQLQHEAAVP

SEQ ID NO: 23868 - protein, 195 aa, Homo sapiens
  Payload ID: 4772
  Gene Symbol: DOHH
  Gene Name: deoxyhypusine hydroxylase/monooxygenase
  ENSP ID: ENSP00000468416
  MOD_RES (1)..(1): Any amino acid
XDSALLKHELAYCLGQMQDARAIPMLVDVLQDTRQEPMVRHEAGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGEEGLLGWGPGQCLAVRFSDGICAVGPRPAPGNGIPGLAPSISHGAS

SEQ ID NO: 23869 - protein, 369 aa, Homo sapiens
  Payload ID: 4773
  Gene Symbol: DHPS
  Gene Name: deoxyhypusine synthase
  Uniprot ID: P49366
  ENSP ID: ENSP00000210060
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 23870 - protein, 322 aa, Homo sapiens
  Payload ID: 4773
  Gene Symbol: DHPS
  Gene Name: deoxyhypusine synthase
  Uniprot ID: P49366
  ENSP ID: ENSP00000221303
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEAQEFDGSDSGARPDEAVSWGKIRVDAQPVKVYADASLVFPLLVAETFAQKMDAFMHEKNED

SEQ ID NO: 23871 - protein, 132 aa, Homo sapiens
  Payload ID: 4773
  Gene Symbol: DHPS
  Gene Name: deoxyhypusine synthase
  ENSP ID: ENSP00000468889
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVGTWWTYW

SEQ ID NO: 23872 - protein, 139 aa, Homo sapiens
  Payload ID: 4773
  Gene Symbol: DHPS
  Gene Name: deoxyhypusine synthase
  ENSP ID: ENSP00000468993
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRGRIGDHSWRRGGRPHQVPGAHILGRV

SEQ ID NO: 23873 - protein, 27 aa, Homo sapiens
  Payload ID: 4773
  Gene Symbol: DHPS
  Gene Name: deoxyhypusine synthase
  ENSP ID: ENSP00000469366
  MOD_RES (1)..(1): Any amino acid
XPDEAVSWGKIRVDAQPVKVPPYPGLC

SEQ ID NO: 23874 - protein, 90 aa, Homo sapiens
  Payload ID: 4773
  Gene Symbol: DHPS
  Gene Name: deoxyhypusine synthase
  ENSP ID: ENSP00000470188
MPIIPAFWEAEAGGSREEEFETSLANMIEKKLEPLSQDEDQHADLTQSRRPLTSCTIFLGYTSNLISSGIRETIRYLVQHNMVGTWWTYW

SEQ ID NO: 23875 - protein, 56 aa, Homo sapiens
  Payload ID: 4773
  Gene Symbol: DHPS
  Gene Name: deoxyhypusine synthase
  ENSP ID: ENSP00000470754
  MOD_RES (1)..(1): Any amino acid
XADLTQSRRPLTSCTIFLGYTSNLISSGIRGRIGDHSWRRGGRPHQVPGAHILGRV

SEQ ID NO: 23876 - protein, 68 aa, Homo sapiens
  Payload ID: 4773
  Gene Symbol: DHPS
  Gene Name: deoxyhypusine synthase
  ENSP ID: ENSP00000471280
  MOD_RES (1)..(1): Any amino acid
XMIEKKLEPLSQDEDQHADLTQSRRPLTSCTIFLGYTSNLISSGIRETIRYLVQHNMQSSLIRVTGQG

SEQ ID NO: 23877 - protein, 159 aa, Homo sapiens
  Payload ID: 4773
  Gene Symbol: DHPS
  Gene Name: deoxyhypusine synthase
  ENSP ID: ENSP00000471466
  MOD_RES (1)..(1): Any amino acid
XMIARLGKEINNPESVYYWAQKNHIPVFSPALTDGSLGDMIFFHSYKNPGLVLDIVEDLRLINTQAIFAKCTGMIILGGGVVKHHIANANLMVPDQTRLSPGARSGWMHSPSRSMLTPPWSSPCLWLKPLPRRWMPSCMRRTRTERLRSQEGLTPSSIY

SEQ ID NO: 23878 - protein, 327 aa, Homo sapiens
  Payload ID: 4773
  Gene Symbol: DHPS
  Gene Name: deoxyhypusine synthase
  Uniprot ID: P49366
  ENSP ID: ENSP00000471886
MPIIPAFWEAEAGGSREEEFETSLANMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 23879 - protein, 138 aa, Homo sapiens
  Payload ID: 4773
  Gene Symbol: DHPS
  Gene Name: deoxyhypusine synthase
  ENSP ID: ENSP00000472094
MVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVE

SEQ ID NO: 23880 - protein, 115 aa, Homo sapiens
  Payload ID: 4773
  Gene Symbol: DHPS
  Gene Name: deoxyhypusine synthase
  ENSP ID: ENSP00000472096
VKWTPSKMIARLGKEINNPESVYYWAQKNHIPVFSPALTDGSLGDMIFFHSYKNPGLVLDIVEGARPDEAVSWGKIRVDAQPVKVYADASLVFPLLVAETFAQKMDAFMHEKNED

SEQ ID NO: 23881 - protein, 277 aa, Homo sapiens
  Payload ID: 4773
  Gene Symbol: DHPS
  Gene Name: deoxyhypusine synthase
  ENSP ID: ENSP00000472122
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEAERGRLRCLHQHSPGV

SEQ ID NO: 23882 - protein, 132 aa, Homo sapiens
  Payload ID: 4773
  Gene Symbol: DHPS
  Gene Name: deoxyhypusine synthase
  ENSP ID: ENSP00000472330
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMDRKPAGAQ

SEQ ID NO: 23883 - protein, 182 aa, Homo sapiens
  Payload ID: 4773
  Gene Symbol: DHPS
  Gene Name: deoxyhypusine synthase
  ENSP ID: ENSP00000472348
MLIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHS

SEQ ID NO: 23884 - protein, 370 aa, Homo sapiens [sequence omitted]

SEQ ID NO: 23885 - protein, 329 aa, Homo sapiens
  Payload ID: 4774
  Gene Symbol: DNTTIP1
  Gene Name: deoxynucleotidyltransferase, terminal, interacting protein 1
  Uniprot ID: Q9H147
  ENSP ID: ENSP00000361705
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 23886 - protein, 145 aa, Homo sapiens
  Payload ID: 4774
  Gene Symbol: DNTTIP1
  Gene Name: deoxynucleotidyltransferase, terminal, interacting protein 1
  ENSP ID: ENSP00000392509
MIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGM

SEQ ID NO: 23887 - protein, 150 aa, Homo sapiens
  Payload ID: 4774
  Gene Symbol: DNTTIP1
  Gene Name: deoxynucleotidyltransferase, terminal, interacting protein 1
  ENSP ID: ENSP00000395609
DAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQVRGGSSYHGPIWYHGDEHPAASLPLWCGQEA

SEQ ID NO: 23888 - protein, 232 aa, Homo sapiens
  Payload ID: 4774
  Gene Symbol: DNTTIP1
  Gene Name: deoxynucleotidyltransferase, terminal, interacting protein 1
  ENSP ID: ENSP00000400573
  MOD_RES (1)..(1): Any amino acid
XQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKAYLLIEEDIRDLAASDDYRGCLDLKLEELKSFVLPSWMVEKMRKYMETLRTENEHRAVEAPPQT

SEQ ID NO: 23889 - protein, 280 aa, Homo sapiens
  Payload ID: 4774
  Gene Symbol: DNTTIP1
  Gene Name: deoxynucleotidyltransferase, terminal, interacting protein 1
  ENSP ID: ENSP00000401024
  MOD_RES (1)..(1): Any amino acid
XRGGLELGDAGAAGQLVLTNPWNIMIKHRQVQRRGRRSQMTTSFTDPAISMDLLRAVLQPSINEEIQTVFNKYMKAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 23890 - protein, 601 aa, Homo sapiens
  Payload ID: 4775
  Gene Symbol: DNTTIP2
  Gene Name: deoxynucleotidyltransferase, terminal, interacting protein 2
  ENSP ID: ENSP00000352137
MVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLFCRKPSLHLILKKTTVFHHIVNQSINFRKNAEKNDKKQQGMAGLV

SEQ ID NO: 23891 - protein, 756 aa, Homo sapiens
  Payload ID: 4775
  Gene Symbol: DNTTIP2
  Gene Name: deoxynucleotidyltransferase, terminal, interacting protein 2
  Uniprot ID: Q5QJE6
  ENSP ID: ENSP00000411010
MVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 23892 - protein, 161 aa, Homo sapiens
  Payload ID: 4775
  Gene Symbol: DNTTIP2
  Gene Name: deoxynucleotidyltransferase, terminal, interacting protein 2
  ENSP ID: ENSP00000434261
MVVTRSARAKASIQAASAESSGQKCVFSGLQSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIV

SEQ ID NO: 23893 - protein, 282 aa, Homo sapiens [sequence omitted]

SEQ ID NO: 23894 - protein, 282 aa, Homo sapiens [sequence omitted]

SEQ ID NO: 23895 - protein, 86 aa, Homo sapiens
  Payload ID: 4776
  Gene Symbol: DNASE1
  Gene Name: deoxyribonuclease I
  ENSP ID: ENSP00000458467
MRGMKLLGALLALAALLQGAVSLKIAAFNIQTFGETKMSNATLVSYIVQILSRYDIALVQEVRDSHLTAVGKLLDNLNQWVTVAGS

SEQ ID NO: 23896 - protein, 90 aa, Homo sapiens
  Payload ID: 4776
  Gene Symbol: DNASE1
  Gene Name: deoxyribonuclease I
  ENSP ID: ENSP00000458959
  MOD_RES (1)..(1): Any amino acid
XHYVVSEPLGRNSYKERYLFVYRPDQVSAVDSYYYDDGCEPCGNDTFNREPAIVRFFSRFTGSVPHTTWLSPQRSGSLPLFPCMRPRGTQ

SEQ ID NO: 23897 - protein, 108 aa, Homo sapiens
  Payload ID: 4776
  Gene Symbol: DNASE1
  Gene Name: deoxyribonuclease I
  ENSP ID: ENSP00000459507
NREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRLPMA

SEQ ID NO: 23898 - protein, 60 aa, Homo sapiens
  Payload ID: 4776
  Gene Symbol: DNASE1
  Gene Name: deoxyribonuclease I
  ENSP ID: ENSP00000459850
MRGMKLLGALLALAALLQGAVSLKIAAFNIQTFGETKMSNATLVSYIVQGCTRHLSLRGQ

SEQ ID NO: 23899 - protein, 72 aa, Homo sapiens
  Payload ID: 4776
  Gene Symbol: DNASE1
  Gene Name: deoxyribonuclease I
  ENSP ID: ENSP00000461129
SIRLWTSPTFQWLIPDSADTTATPTHCAYDRIVVAGMLLRGAVVPDSALPFNFQAAYGLSDQLVCVLPCTAT

SEQ ID NO: 23900 - protein, 65 aa, Homo sapiens
  Payload ID: 4776
  Gene Symbol: DNASE1
  Gene Name: deoxyribonuclease I
  ENSP ID: ENSP00000461153
  MOD_RES (1)..(1): Any amino acid
XTFQWLIPDSADTTATPTHCAYDRIVVAGMLLRGAVVPDSALPFNFQAAYGLSDQLVCVLPCTAT

SEQ ID NO: 23901 - protein, 75 aa, Homo sapiens
  Payload ID: 4776
  Gene Symbol: DNASE1
  Gene Name: deoxyribonuclease I
  ENSP ID: ENSP00000461527
  MOD_RES (1)..(1): Any amino acid
XRYLFVYRPDQVSAVDSYYYDDGCEPCGNDTFNREPAIVRFFSRFTGSVPHTTWLSPQRSGSLPLFPCMRPRGTQ

SEQ ID NO: 23902 - protein, 60 aa, Homo sapiens; identical to SEQ ID NO: 23898
  Payload ID: 4776
  Gene Symbol: DNASE1
  Gene Name: deoxyribonuclease I
  ENSP ID: ENSP00000461725

SEQ ID NO: 23903 - protein, 60 aa, Homo sapiens; identical to SEQ ID NO: 23898
  Payload ID: 4776
  Gene Symbol: DNASE1
  Gene Name: deoxyribonuclease I
  ENSP ID: ENSP00000461745

SEQ ID NO: 23904 - protein, 153 aa, Homo sapiens
  Payload ID: 4777
  Gene Symbol: DNASE2B
  Gene Name: deoxyribonuclease II beta
  Uniprot ID: Q8WZ79
  ENSP ID: ENSP00000359696
MPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 23905 - protein, 361 aa, Homo sapiens
  Payload ID: 4777
  Gene Symbol: DNASE2B
  Gene Name: deoxyribonuclease II beta
  Uniprot ID: Q8WZ79
  ENSP ID: ENSP00000359699
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 23906 - protein, 360 aa, Homo sapiens
  Payload ID: 4778
  Gene Symbol: DNASE2
  Gene Name: deoxyribonuclease II, lysosomal
  Uniprot ID: O00115
  ENSP ID: ENSP00000222219
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 23907 - protein, 218 aa, Homo sapiens
  Payload ID: 4778
  Gene Symbol: DNASE2
  Gene Name: deoxyribonuclease II, lysosomal
  ENSP ID: ENSP00000466912
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQV

SEQ ID NO: 23908 - protein, 302 aa, Homo sapiens
  Payload ID: 4779
  Gene Symbol: DNASE1L1
  Gene Name: deoxyribonuclease I-like 1
  Uniprot ID: P49184
  ENSP ID: ENSP00000014935
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 23909 - protein, 302 aa, Homo sapiens; identical to SEQ ID NO: 23908
  Payload ID: 4779
  Gene Symbol: DNASE1L1
  Gene Name: deoxyribonuclease I-like 1
  Uniprot ID: P49184
  ENSP ID: ENSP00000309168

SEQ ID NO: 23910 - protein, 302 aa, Homo sapiens; identical to SEQ ID NO: 23908
  Payload ID: 4779
  Gene Symbol: DNASE1L1
  Gene Name: deoxyribonuclease I-like 1
  Uniprot ID: P49184
  ENSP ID: ENSP00000358822

SEQ ID NO: 23911 - protein, 302 aa, Homo sapiens; identical to SEQ ID NO: 23908
  Payload ID: 4779
  Gene Symbol: DNASE1L1
  Gene Name: deoxyribonuclease I-like 1
  Uniprot ID: P49184
  ENSP ID: ENSP00000358823

SEQ ID NO: 23912 - protein, 302 aa, Homo sapiens; identical to SEQ ID NO: 23908
  Payload ID: 4779
  Gene Symbol: DNASE1L1
  Gene Name: deoxyribonuclease I-like 1
  Uniprot ID: P49184
  ENSP ID: ENSP00000358824

SEQ ID NO: 23913 - protein, 302 aa, Homo sapiens; identical to SEQ ID NO: 23908
  Payload ID: 4779
  Gene Symbol: DNASE1L1
  Gene Name: deoxyribonuclease I-like 1
  Uniprot ID: P49184
  ENSP ID: ENSP00000377255

SEQ ID NO: 23914 - protein, 103 aa, Homo sapiens
  Payload ID: 4779
  Gene Symbol: DNASE1L1
  Gene Name: deoxyribonuclease I-like 1
  ENSP ID: ENSP00000393000
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFY

SEQ ID NO: 23915 - protein, 208 aa, Homo sapiens
  Payload ID: 4779
  Gene Symbol: DNASE1L1
  Gene Name: deoxyribonuclease I-like 1
  ENSP ID: ENSP00000393346
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHW

SEQ ID NO: 23916 - protein, 85 aa, Homo sapiens
  Payload ID: 4779
  Gene Symbol: DNASE1L1
  Gene Name: deoxyribonuclease I-like 1
  ENSP ID: ENSP00000395591
MHYPTALLFLILANGAQAFRICAFNAQRLTLAKVAREQVMDTLVRALNISDHYPVEVELKLSQAHSVQPLSLTVLLLLSLLSPQL

SEQ ID NO: 23917 - protein, 26 aa, Homo sapiens
  Payload ID: 4779
  Gene Symbol: DNASE1L1
  Gene Name: deoxyribonuclease I-like 1
  ENSP ID: ENSP00000410281
MHYPTALLFLILANGAQAFRICAFNA

SEQ ID NO: 23918 - protein, 62 aa, Homo sapiens
  Payload ID: 4779
  Gene Symbol: DNASE1L1
  Gene Name: deoxyribonuclease I-like 1
  ENSP ID: ENSP00000416881
MHYPTALLFLILANGAQAFRICAFNAQRLTLAKVAREQVMDTLVRDVILLGDFNADCASLTK

SEQ ID NO: 23919 - protein, 299 aa, Homo sapiens
  Payload ID: 4780
  Gene Symbol: DNASE1L2
  Gene Name: deoxyribonuclease I-like 2
  Uniprot ID: Q92874
  ENSP ID: ENSP00000316938
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 23920 - protein, 278 aa, Homo sapiens
  Payload ID: 4780
  Gene Symbol: DNASE1L2
  Gene Name: deoxyribonuclease I-like 2
  Uniprot ID: Q92874
  ENSP ID: ENSP00000371874
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 23921 - protein, 299 aa, Homo sapiens; identical to SEQ ID NO: 23919
  Payload ID: 4780
  Gene Symbol: DNASE1L2
  Gene Name: deoxyribonuclease I-like 2
  Uniprot ID: Q92874
  ENSP ID: ENSP00000454562

SEQ ID NO: 23922 - protein, 299 aa, Homo sapiens; identical to SEQ ID NO: 23919
  Payload ID: 4780
  Gene Symbol: DNASE1L2
  Gene Name: deoxyribonuclease I-like 2
  Uniprot ID: Q92874
  ENSP ID: ENSP00000455358

SEQ ID NO: 23923 - protein, 254 aa, Homo sapiens
  Payload ID: 4780
  Gene Symbol: DNASE1L2
  Gene Name: deoxyribonuclease I-like 2
  ENSP ID: ENSP00000455478
PRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDWAAIRLRSSEVFKWLIPDSADTTVGNSDCAYDRIVACGARLRRSLKPQSATVHDFQEEF

SEQ ID NO: 23924 - protein, 278 aa, Homo sapiens; identical to SEQ ID NO: 23920
  Payload ID: 4780
  Gene Symbol: DNASE1L2
  Gene Name: deoxyribonuclease I-like 2
  Uniprot ID: Q92874
  ENSP ID: ENSP00000482627

SEQ ID NO: 23925 - protein, 305 aa, Homo sapiens
  Payload ID: 4781
  Gene Symbol: DNASE1L3
  Gene Name: deoxyribonuclease I-like 3
  Uniprot ID: Q13609
  ENSP ID: ENSP00000378053
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 23926 - protein, 288 aa, Homo sapiens
  Payload ID: 4781
  Gene Symbol: DNASE1L3
  Gene Name: deoxyribonuclease I-like 3
  ENSP ID: ENSP00000417047
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEVRLPSCLSMPLSWKDELAWAT

SEQ ID NO: 23927 - protein, 137 aa, Homo sapiens
  Payload ID: 4781
  Gene Symbol: DNASE1L3
  Gene Name: deoxyribonuclease I-like 3
  ENSP ID: ENSP00000417976
ADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRPWMSATTFQLNLNYSLQGPSPTAKNLSL

SEQ ID NO: 23928 - protein, 157 aa, Homo sapiens
  Payload ID: 4781
  Gene Symbol: DNASE1L3
  Gene Name: deoxyribonuclease I-like 3
  ENSP ID: ENSP00000418113
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTT

SEQ ID NO: 23929 - protein, 100 aa, Homo sapiens
  Payload ID: 4781
  Gene Symbol: DNASE1L3
  Gene Name: deoxyribonuclease I-like 3
  ENSP ID: ENSP00000418509
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKE

SEQ ID NO: 23930 - protein, 275 aa, Homo sapiens
  Payload ID: 4781
  Gene Symbol: DNASE1L3
  Gene Name: deoxyribonuclease I-like 3
  Uniprot ID: Q13609
  ENSP ID: ENSP00000419052
MSRELAPLLLLLLSIHSALAMRICSFNVRSFGESKQEDKNAMDVIVKVIKRCDIILVMEIKDSNNRICPILMEKLNREKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 23931 - protein, 318 aa, Homo sapiens
  Payload ID: 4782
  Gene Symbol: DERA
  Gene Name: deoxyribose-phosphate aldolase (putative)
  Uniprot ID: Q9Y315
  ENSP ID: ENSP00000416583
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 23932 - protein, 230 aa, Homo sapiens
  Payload ID: 4782
  Gene Symbol: DERA
  Gene Name: deoxyribose-phosphate aldolase (putative)
  ENSP ID: ENSP00000431757
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 23933 - protein, 98 aa, Homo sapiens
  Payload ID: 4782
  Gene Symbol: DERA
  Gene Name: deoxyribose-phosphate aldolase (putative)
  ENSP ID: ENSP00000432633
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAH

SEQ ID NO: 23934 - protein, 236 aa, Homo sapiens
  Payload ID: 4782
  Gene Symbol: DERA
  Gene Name: deoxyribose-phosphate aldolase (putative)
  ENSP ID: ENSP00000433051
MSAHNRGTELARWLENPTTQKTKPKTNNPQADLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSD

SEQ ID NO: 23935 - protein, 66 aa, Homo sapiens
  Payload ID: 4782
  Gene Symbol: DERA
  Gene Name: deoxyribose-phosphate aldolase (putative)
  ENSP ID: ENSP00000433801
MSAHNRGTELDLSWISKIQVNHPAVLRRAEQIQARRTVKKEWQVMIHLPTFKGSVIKPNTQSGKIS

SEQ ID NO: 23936 - protein, 163 aa, Homo sapiens
  Payload ID: 4782
  Gene Symbol: DERA
  Gene Name: deoxyribose-phosphate aldolase (putative)
  ENSP ID: ENSP00000434973
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKV

SEQ ID NO: 23937 - protein, 60 aa, Homo sapiens
  Payload ID: 4782
  Gene Symbol: DERA
  Gene Name: deoxyribose-phosphate aldolase (putative)
  ENSP ID: ENSP00000435683
MSAHNRGTELDLSWISKIQVNHPAVLRRAEQIQARRTVKKEWQALLQPPFVFIPPGCVML

SEQ ID NO: 23938 - protein, 275 aa, Homo sapiens
  Payload ID: 4782
  Gene Symbol: DERA
  Gene Name: deoxyribose-phosphate aldolase (putative)
  ENSP ID: ENSP00000436999
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 23939 - protein, 212 aa, Homo sapiens
  Payload ID: 4783
  Gene Symbol: DTYMK
  Gene Name: deoxythymidylate kinase (thymidylate kinase)
  Uniprot ID: P23919
  ENSP ID: ENSP00000304802
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 23940 - protein, 83 aa, Homo sapiens
  Payload ID: 4783
  Gene Symbol: DTYMK
  Gene Name: deoxythymidylate kinase (thymidylate kinase)
  ENSP ID: ENSP00000383581
MAARRGALIVLEGVDRAGKSTQSRKLVEALCAAGHRAELLRFPERSTEIGKLLSSYLQKKSDVEDHSVHLLFSANRWEQVIFP

SEQ ID NO: 23941 - protein, 192 aa, Homo sapiens
  Payload ID: 4783
  Gene Symbol: DTYMK
  Gene Name: deoxythymidylate kinase (thymidylate kinase)
  ENSP ID: ENSP00000387379
  MOD_RES (1)..(1): Any amino acid
XRSTEIGKLLSSYLQKKSDVEDHSVHLLFSANRWEQVFILVAQTGVQWGDLGSLQPTPRRFKRFSCLSLSSSCDHRPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSE

SEQ ID NO: 23942 - protein, 170 aa, Homo sapiens
  Payload ID: 4783
  Gene Symbol: DTYMK
  Gene Name: deoxythymidylate kinase (thymidylate kinase)
  ENSP ID: ENSP00000408939
  MOD_RES (1)..(1): Any amino acid
XKLVEALCAAGHRAELLRFPERSTEIGKLLSSYLQKKSDVEDHSVHLLFSANRWEQVRFPLHSTLNVDNFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 23943 - protein, 101 aa, Homo sapiens
  Payload ID: 4783
  Gene Symbol: DTYMK
  Gene Name: deoxythymidylate kinase (thymidylate kinase)
  ENSP ID: ENSP00000410647
  MOD_RES (1)..(1): Any amino acid
XDRAGKSTQSRKLVEALCAAGHRAELLRFPERSTEIGKLLSSYLQKKSDVEDHSVHLLFSANRWEQVQGLCVMQAECSAQSQLTAASTSRVQVIFPPQPPK

SEQ ID NO: 23944 - protein, 252 aa, Homo sapiens
  Payload ID: 4784
  Gene Symbol: DUT
  Gene Name: deoxyuridine triphosphatase
  Uniprot ID: P33316
  ENSP ID: ENSP00000370376
MTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 23945 - protein, 164 aa, Homo sapiens
  Payload ID: 4784
  Gene Symbol: DUT
  Gene Name: deoxyuridine triphosphatase
  Uniprot ID: P33316
  ENSP ID: ENSP00000405160
MPCSEETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 23946 - protein, 221 aa, Homo sapiens
  Payload ID: 4784
  Gene Symbol: DUT
  Gene Name: deoxyuridine triphosphatase
  ENSP ID: ENSP00000452749
MTPLCPRPALCYHFLTSLLRSAMQNARGARQRAEAAVLSGPGPPLGRAAQHGIPRPLSSAGRLSQGCRGAKTPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSG

SEQ ID NO: 23947 - protein, 226 aa, Homo sapiens
  Payload ID: 4784
  Gene Symbol: DUT
  Gene Name: deoxyuridine triphosphatase
  ENSP ID: ENSP00000452814
MTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEGYGECVSNVSNKLFFL

SEQ ID NO: 23948 - protein, 133 aa, Homo sapiens
  Payload ID: 4784
  Gene Symbol: DUT
  Gene Name: deoxyuridine triphosphatase
  ENSP ID: ENSP00000453667
MAAGGAAPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEDRIWRMCQ

SEQ ID NO: 23949 - protein, 107 aa, Homo sapiens
  Payload ID: 4784
  Gene Symbol: DUT
  Gene Name: deoxyuridine triphosphatase
  ENSP ID: ENSP00000453683
MLCSIEKPSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDD

SEQ ID NO: 23950 - protein, 141 aa, Homo sapiens
  Payload ID: 4784
  Gene Symbol: DUT
  Gene Name: deoxyuridine triphosphatase
  ENSP ID: ENSP00000453717
MQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 23951 - protein, 143 aa, Homo sapiens
  Payload ID: 4784
  Gene Symbol: DUT
  Gene Name: deoxyuridine triphosphatase
  ENSP ID: ENSP00000454041
MPCSEETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEGMLNIYIHIILVNFQSHVCVN

SEQ ID NO: 23952 - protein, 167 aa, Homo sapiens
  Payload ID: 4784
  Gene Symbol: DUT
  Gene Name: deoxyuridine triphosphatase
  ENSP ID: ENSP00000454183
MAAGGAAPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 23953 - protein, 527 aa, Homo sapiens
  Payload ID: 4785
  Gene Symbol: DEPDC1
  Gene Name: DEP domain containing 1
  Uniprot ID: Q5TB30
  ENSP ID: ENSP00000360005
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 23954 - protein, 811 aa, Homo sapiens
  Payload ID: 4785
  Gene Symbol: DEPDC1
  Gene Name: DEP domain containing 1
  Uniprot ID: Q5TB30
  ENSP ID: ENSP00000412292
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 23955 - protein, 34 aa, Homo sapiens
  Payload ID: 4785
  Gene Symbol: DEPDC1
  Gene Name: DEP domain containing 1
  ENSP ID: ENSP00000431477
MYNMANTSKRGVVILQNKSDDLPHWVLSAMKCLA

SEQ ID NO: 23956 - protein, 308 aa, Homo sapiens
  Payload ID: 4785
  Gene Symbol: DEPDC1
  Gene Name: DEP domain containing 1
  ENSP ID: ENSP00000436464
  MOD_RES (1)..(1): Any amino acid
XTIQLLRKFLKNHVIEDIKGRWGSENVDDNNQLFRFPATSPLKTLPRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGNFKDFRSSIPVVCGYITVSDRSSGIHKIQDDPQSSKFLHLNNLNSFKSTECLLLSLLHREKNKEESDSTERLQISNPGFQERCAKKMQLVNLRNRRACCNLI

SEQ ID NO: 23957 - protein, 529 aa, Homo sapiens
  Payload ID: 4786
  Gene Symbol: DEPDC1B
  Gene Name: DEP domain containing 1B
  Uniprot ID: Q8WUY9
  ENSP ID: ENSP00000265036
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 23958 - protein, 467 aa, Homo sapiens
  Payload ID: 4786
  Gene Symbol: DEPDC1B
  Gene Name: DEP domain containing 1B
  Uniprot ID: Q8WUY9
  ENSP ID: ENSP00000389101
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQFQKSYPEVYQERFPTPESAALLFPEKPKPKPQLLMWALKKPFQPFQRTRSFRM

SEQ ID NO: 23959 - protein, 36 aa, Homo sapiens
  Payload ID: 4786
  Gene Symbol: DEPDC1B
  Gene Name: DEP domain containing 1B
  ENSP ID: ENSP00000426979
MEHRIVGPGPYRATRLFLFLRPGAVAHSCNSSTLGG

SEQ ID NO: 23960 - protein, 22 aa, Homo sapiens
  Payload ID: 4786
  Gene Symbol: DEPDC1B
  Gene Name: DEP domain containing 1B
  ENSP ID: ENSP00000427527
MEHRIVGPGPYRATRLGLILLS

SEQ ID NO: 23961 - protein, 57 aa, Homo sapiens
  Payload ID: 4787
  Gene Symbol: DEPDC4
  Gene Name: DEP domain containing 4
  Uniprot ID: Q8N2C3
  ENSP ID: ENSP00000299185
MVPGEEPARELMAVLLTPRFRRLVSQNELPGPGLNGPSSRNRRDGFCRKRRTDQDMK

SEQ ID NO: 23962 - protein, 294 aa, Homo sapiens
  Payload ID: 4787
  Gene Symbol: DEPDC4
  Gene Name: DEP domain containing 4
  Uniprot ID: Q8N2C3
  ENSP ID: ENSP00000367490
MVPGEEPARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEK

SEQ ID NO: 23963 - protein, 294 aa, Homo sapiens; identical to SEQ ID NO: 23962
  Payload ID: 4787
  Gene Symbol: DEPDC4
  Gene Name: DEP domain containing 4
  Uniprot ID: Q8N2C3
  ENSP ID: ENSP00000396234

SEQ ID NO: 23964 - protein, 57 aa, Homo sapiens; identical to SEQ ID NO: 23961
  Payload ID: 4787
  Gene Symbol: DEPDC4
  Gene Name: DEP domain containing 4
  Uniprot ID: Q8N2C3
  ENSP ID: ENSP00000447392

SEQ ID NO: 23965 - protein, 333 aa, Homo sapiens
  Payload ID: 4787
  Gene Symbol: DEPDC4
  Gene Name: DEP domain containing 4
  ENSP ID: ENSP00000448338
MVPGEEPARELMAVLLTPRFRRLVSQNELPGPGLNGPSSRNRRDGFCRKRRTGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEGVSFYTAITSDKTDVWKEQTLLCLLQLIHLPFLDNILEPPVKTQNLQLNKEEDLVITNTCLDRELIPSLCLPEIDNWLNAAIECLEYFPDQLIVTVSQQLMQNRNEETRLNSQKKILFDVIAKYYAQERDCLLTDEYFDIHSGIIELLENEKRAEALEATQLYLRLL

SEQ ID NO: 23966 - protein, 387 aa, Homo sapiens
  Payload ID: 4787
  Gene Symbol: DEPDC4
  Gene Name: DEP domain containing 4
  ENSP ID: ENSP00000448385
MVPGEEPARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEIDNWLNAAIECLEYFPDQLIVTVSQQLMQNRNEETRLNSQKKILFDVIAKYYAQERDCLLTDEYFDIHSGIIELLENEKRAEALEATQLYLRLL

SEQ ID NO: 23967 - protein, 105 aa, Homo sapiens
  Payload ID: 4787
  Gene Symbol: DEPDC4
  Gene Name: DEP domain containing 4
  ENSP ID: ENSP00000448728
  MOD_RES (1)..(1): Any amino acid
XIEELIHTINGNPALCPNITVQKPFLRLSKEGVSFYTAITSDKTDVWKEQTLLCLLQLIHLPFLDNILEPPVKTQNLQLNKEEDLVITNTCLDRELIPSLCLPEK

SEQ ID NO: 23968 - protein, 286 aa, Homo sapiens
  Payload ID: 4787
  Gene Symbol: DEPDC4
  Gene Name: DEP domain containing 4
  ENSP ID: ENSP00000449590
ARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPE

SEQ ID NO: 23969 - protein, 1552 aa, Homo sapiens
  Payload ID: 4788
  Gene Symbol: DEPDC5
  Gene Name: DEP domain containing 5
  Uniprot ID: O75140
  ENSP ID: ENSP00000371545
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSLGLYKINILPLLLTSLLRTSLSISTLQEQCFCSCPTPSASSQGSSGGGGTPPAPPTRTCSARSGSATTGPTTPCSPKHGAPAPQGMKSLLIGC

SEQ ID NO: 23970 - protein, 1594 aa, Homo sapiens
  Payload ID: 4788
  Gene Symbol: DEPDC5
  Gene Name: DEP domain containing 5
  Uniprot ID: O75140
  ENSP ID: ENSP00000371546
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 23971 - protein, 559 aa, Homo sapiens
  Payload ID: 4788
  Gene Symbol: DEPDC5
  Gene Name: DEP domain containing 5
  Uniprot ID: O75140
  ENSP ID: ENSP00000383101
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTREHLG

SEQ ID NO: 23972 - protein, 1603 aa, Homo sapiens
  Payload ID: 4788
  Gene Symbol: DEPDC5
  Gene Name: DEP domain containing 5
  Uniprot ID: O75140
  ENSP ID: ENSP00000383105
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 23973 - protein, 1572 aa, Homo sapiens
  Payload ID: 4788
  Gene Symbol: DEPDC5
  Gene Name: DEP domain containing 5
  Uniprot ID: O75140
  ENSP ID: ENSP00000383107
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 23974 - protein, 1572 aa, Homo sapiens; identical to SEQ ID NO: 23973
  Payload ID: 4788
  Gene Symbol: DEPDC5
  Gene Name: DEP domain containing 5
  Uniprot ID: O75140
  ENSP ID: ENSP00000383108

SEQ ID NO: 23975 - protein, 659 aa, Homo sapiens
  Payload ID: 4788
  Gene Symbol: DEPDC5
  Gene Name: DEP domain containing 5
  ENSP ID: ENSP00000402173
APGRFHVGSAESMLHVRPGGYTPQRALINPFAPSRMPMKLTSNRRRWMHTFPVGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKDGAFFMEFVRSPRTASSAFYPQVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQWPCSSPPPPGTQQEWTTSPASSASGLRWPLWQKSSCTLRFLPFSCPGCLAGQPPMQVGTAPLAEVLEDGARRQHF

SEQ ID NO: 23976 - protein, 26 aa, Homo sapiens
  Payload ID: 4788
  Gene Symbol: DEPDC5
  Gene Name: DEP domain containing 5
  ENSP ID: ENSP00000405351
MRTTKVYKLVIHKKGFGGSVAELSFR

SEQ ID NO: 23977 - protein, 979 aa, Homo sapiens
  Payload ID: 4788
  Gene Symbol: DEPDC5
  Gene Name: DEP domain containing 5
  ENSP ID: ENSP00000410544
  MOD_RES (1)..(1): Any amino acid
XSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 23978 - protein, 60 aa, Homo sapiens
  Payload ID: 4788
  Gene Symbol: DEPDC5
  Gene Name: DEP domain containing 5
  ENSP ID: ENSP00000412057
  MOD_RES (1)..(1): Any amino acid
XAGIRAQAGELWVKNEKVMCGYISEDTRVVFRSTSAMVYIFIQMSCEMWDFDIYGTVSMC

SEQ ID NO: 23979 - protein, 45 aa, Homo sapiens
  Payload ID: 4788
  Gene Symbol: DEPDC5
  Gene Name: DEP domain containing 5
  ENSP ID: ENSP00000416314
MRTTKVYKLVIHKKGFGGSDDELVVNPKVFPHIKLGDIVEIAHPN

SEQ ID NO: 23980 - protein, 1503 aa, Homo sapiens
  Payload ID: 4788
  Gene Symbol: DEPDC5
  Gene Name: DEP domain containing 5
  Uniprot ID: O75140
  ENSP ID: ENSP00000440210
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGMNPRTQNKDSLEDSVSTSPDPILTLSAPPVVPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 23981 - protein, 511 aa, Homo sapiens
  Payload ID: 4789
  Gene Symbol: DEPDC7
  Gene Name: DEP domain containing 7
  Uniprot ID: Q96QD5
  ENSP ID: ENSP00000241051
MATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 23982 - protein, 502 aa, Homo sapiens
  Payload ID: 4789
  Gene Symbol: DEPDC7
  Gene Name: DEP domain containing 7
  Uniprot ID: Q96QD5
  ENSP ID: ENSP00000308971
MRGLCEFYWQEFGIKGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 23983 - protein, 533 aa, Homo sapiens
  Payload ID: 4789
  Gene Symbol: DEPDC7
  Gene Name: DEP domain containing 7
  ENSP ID: ENSP00000479957
MARGRSSLAHFVLQTARSQESACLPRLFLGGMRGLCEFYWQEFGIKGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 23984 - protein, 409 aa, Homo sapiens
  Payload ID: 4790
  Gene Symbol: DEPTOR
  Gene Name: DEP domain containing MTOR-interacting protein
  Uniprot ID: Q8TB45
  ENSP ID: ENSP00000286234
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 23985 - protein, 308 aa, Homo sapiens
  Payload ID: 4790
  Gene Symbol: DEPTOR
  Gene Name: DEP domain containing MTOR-interacting protein
  Uniprot ID: Q8TB45
  ENSP ID: ENSP00000430457
MEEGGSTGSAGSDSSTSGSGGAQQRELERMAEVLVTGEQLRLMSPENTLLQPREEEGVKYERTFMASEFLDWLVQEGEATTRKEAEQLCHRLMEHGIIQHVSNKHPFVDSNLLYQFRMNFRRRRRLMELLNEKSPSSQETHDSPFCLRKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 23986 - protein, 231 aa, Homo sapiens
  Payload ID: 4791
  Gene Symbol: DCAKD
  Gene Name: dephospho-CoA kinase domain containing
  Uniprot ID: Q8WVC6
  ENSP ID: ENSP00000308515
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGVLTGLAAIASLLYLLTHYLLPYA

SEQ ID NO: 23987 - protein, 231 aa, Homo sapiens; identical to SEQ ID NO: 23986
  Payload ID: 4791
  Gene Symbol: DCAKD
  Gene Name: dephospho-CoA kinase domain containing
  Uniprot ID: Q8WVC6
  ENSP ID: ENSP00000341504

SEQ ID NO: 23988 - protein, 231 aa, Homo sapiens; identical to SEQ ID NO: 23986
  Payload ID: 4791
  Gene Symbol: DCAKD
  Gene Name: dephospho-CoA kinase domain containing
  Uniprot ID: Q8WVC6
  ENSP ID: ENSP00000413483

SEQ ID NO: 23989 - protein, 231 aa, Homo sapiens; identical to SEQ ID NO: 23986
  Payload ID: 4791
  Gene Symbol: DCAKD
  Gene Name: dephospho-CoA kinase domain containing
  Uniprot ID: Q8WVC6
  ENSP ID: ENSP00000467913

SEQ ID NO: 23990 - protein, 209 aa, Homo sapiens
  Payload ID: 4791
  Gene Symbol: DCAKD
  Gene Name: dephospho-CoA kinase domain containing
  ENSP ID: ENSP00000468809
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGV

SEQ ID NO: 23991 - protein, 231 aa, Homo sapiens; identical to SEQ ID NO: 23986
  Payload ID: 4791
  Gene Symbol: DCAKD
  Gene Name: dephospho-CoA kinase domain containing
  Uniprot ID: Q8WVC6
  ENSP ID: ENSP00000478909

SEQ ID NO: 23992 - protein, 251 aa, Homo sapiens
  Payload ID: 4792
  Gene Symbol: DERL1
  Gene Name: derlin 1
  Uniprot ID: Q9BUN8
  ENSP ID: ENSP00000259512
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 23993 - protein, 231 aa, Homo sapiens
  Payload ID: 4792
  Gene Symbol: DERL1
  Gene Name: derlin 1
  Uniprot ID: Q9BUN8
  ENSP ID: ENSP00000384289
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSYPMDLGGRNFLSTPQFLYRWLPSRRGGVSGFGVPPASMRRAADQNGGGGRHNWGQGFRLGDQ

SEQ ID NO: 23994 - protein, 151 aa, Homo sapiens
  Payload ID: 4792
  Gene Symbol: DERL1
  Gene Name: derlin 1
  ENSP ID: ENSP00000389965
MSDIGDWFRSIPAITRYWFAATVAVPLVGKLGLISPAYLFLWPEAFLYRFQACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 23995 - protein, 151 aa, Homo sapiens
  Payload ID: 4792
  Gene Symbol: DERL1
  Gene Name: derlin 1
  ENSP ID: ENSP00000429199
MLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 23996 - protein, 151 aa, Homo sapiens; identical to SEQ ID NO: 23995
  Payload ID: 4792
  Gene Symbol: DERL1
  Gene Name: derlin 1
  ENSP ID: ENSP00000430086

SEQ ID NO: 23997 - protein, 239 aa, Homo sapiens
  Payload ID: 4793
  Gene Symbol: DERL2
  Gene Name: derlin 2
  Uniprot ID: Q9GZP9
  ENSP ID: ENSP00000158771
MAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 23998 - protein, 200 aa, Homo sapiens
  Payload ID: 4793
  Gene Symbol: DERL2
  Gene Name: derlin 2
  ENSP ID: ENSP00000458296
MAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTQSDRMSKSKELLTQAFTIMLVYVWSRRNPYVRMNFFGLLNFQAPFLPWVLMGFSLLLGNSIIVDLLGIAVGHIYFFLEDVFPNQPGGIRIL

SEQ ID NO: 23999 - protein, 103 aa, Homo sapiens
  Payload ID: 4793
  Gene Symbol: DERL2
  Gene Name: derlin 2
  ENSP ID: ENSP00000458448
MAYQSLRLEYLQIPPVSRAYTTACVLTTAAVVSSCSATFSLSGLDMTGSSGNWGLGLGEAQRGWSRGWVEAYRDYSGVRVGAKNAYPVTREGSAASWGVSSWN

SEQ ID NO: 24000 - protein, 144 aa, Homo sapiens
  Payload ID: 4793
  Gene Symbol: DERL2
  Gene Name: derlin 2
  ENSP ID: ENSP00000459072
MAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTQSDRMSKSKELLTQVLQLDTYIFSWKMYFPINLVE

SEQ ID NO: 24001 - protein, 158 aa, Homo sapiens
  Payload ID: 4793
  Gene Symbol: DERL2
  Gene Name: derlin 2
  ENSP ID: ENSP00000459083
WRLITNFLFFGPVGFNFLFNMIFLYRYCRMLEEGSFRGRTADFVFMFLFGGFLMTQSDRMSKSKELLTQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 24002 - protein, 103 aa, Homo sapiens; identical to SEQ ID NO: 23999
  Payload ID: 4793
  Gene Symbol: DERL2
  Gene Name: derlin 2
  ENSP ID: ENSP00000459154

SEQ ID NO: 24003 - protein, 74 aa, Homo sapiens
  Payload ID: 4793
  Gene Symbol: DERL2
  Gene Name: derlin 2
  ENSP ID: ENSP00000460671
MAYQSLRLEYLQIPPVSRAYTTACVLTTAAVQLELITPFQLYFNPELIFKHFQVLQLDTYIFSWKMYFPINLVE

SEQ ID NO: 24004 - protein, 79 aa, Homo sapiens
  Payload ID: 4793
  Gene Symbol: DERL2
  Gene Name: derlin 2
  ENSP ID: ENSP00000461603
  MOD_RES (1)..(1): Any amino acid
XLRLEYLQIPPVSRAYTTACVLTTAAVQLELITPFQLYFNPELIFKHFQIWRLITNFLFFGPVGFNFLFNMIFLFLVCL

SEQ ID NO: 24005 - protein, 82 aa, Homo sapiens
  Payload ID: 4793
  Gene Symbol: DERL2
  Gene Name: derlin 2
  ENSP ID: ENSP00000467794
  MOD_RES (1)..(1): Any amino acid
XAYQSLRLEYLQIPPVSRAYTTACVLTTAAVQLELITPFQLYFNPELIFKHFQIWRLITNFLFFGPVGFNFLFNMIFLSRTG

SEQ ID NO: 24006 - protein, 235 aa, Homo sapiens
  Payload ID: 4794
  Gene Symbol: DERL3
  Gene Name: derlin 3
  Uniprot ID: Q96Q80
  ENSP ID: ENSP00000315303
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 24007 - protein, 178 aa, Homo sapiens
  Payload ID: 4794
  Gene Symbol: DERL3
  Gene Name: derlin 3
  ENSP ID: ENSP00000384473
MAWQGLAAEFLQVPAVTRAYTAACVLTTAAVFQVRPPRAAHLWARPTHPAPDRPSPVGLEARHQLPLLRAPGIQLLLQHALRVPLLPHAGRGLLPRPHGRLRLHVSLRGRPYDPAGTPGQPVLPGPGSAGLGLWAVEGDPTVRGCLTGIAVGHIYYFLEDVFPNQPGGKRLLQTPGFL

SEQ ID NO: 24008 - protein, 239 aa, Homo sapiens
  Payload ID: 4794
  Gene Symbol: DERL3
  Gene Name: derlin 3
  Uniprot ID: Q96Q80
  ENSP ID: ENSP00000384744
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLGLQSSKAPAGSSLTIWTQQSQGGPGTAGELAAPS

SEQ ID NO: 24009 - protein, 205 aa, Homo sapiens
  Payload ID: 4794
  Gene Symbol: DERL3
  Gene Name: derlin 3
  Uniprot ID: Q96Q80
  ENSP ID: ENSP00000419399
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFL

SEQ ID NO: 24010 - protein, 178 aa, Homo sapiens; identical to SEQ ID NO: 24007
  Payload ID: 4794
  Gene Symbol: DERL3
  Gene Name: derlin 3
  ENSP ID: ENSP00000483251

SEQ ID NO: 24011 - protein, 239 aa, Homo sapiens; identical to SEQ ID NO: 24008
  Payload ID: 4794
  Gene Symbol: DERL3
  Gene Name: derlin 3
  Uniprot ID: Q96Q80
  ENSP ID: ENSP00000483693

SEQ ID NO: 24012 - protein, 205 aa, Homo sapiens; identical to SEQ ID NO: 24009
  Payload ID: 4794
  Gene Symbol: DERL3
  Gene Name: derlin 3
  Uniprot ID: Q96Q80
  ENSP ID: ENSP00000485763

SEQ ID NO: 24013 - protein, 235 aa, Homo sapiens; identical to SEQ ID NO: 24006
  Payload ID: 4794
  Gene Symbol: DERL3
  Gene Name: derlin 3
  Uniprot ID: Q96Q80
  ENSP ID: ENSP00000486587

SEQ ID NO: 24014 - protein, 958 aa, Homo sapiens [sequence omitted]

SEQ ID NO: 24015 - protein, 958 aa, Homo sapiens [sequence omitted]

SEQ ID NO: 24016 - protein, 144 aa, Homo sapiens
  Payload ID: 4795
  Gene Symbol: DSE
  Gene Name: dermatan sulfate epimerase
  ENSP ID: ENSP00000397597
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDA

SEQ ID NO: 24017 - protein, 958 aa, Homo sapiens [sequence omitted]

SEQ ID NO: 24018 - protein, 1222 aa, Homo sapiens
  Payload ID: 4796
  Gene Symbol: DSEL
  Gene Name: dermatan sulfate epimerase-like
  Uniprot ID: Q8IZU8
  ENSP ID: ENSP00000310565
MPKGGAPPWIMALMFTGHLLFLALLMFAFSTFEESVSNYSEWAVFTDDIDQFKTQKVQDFRPNQKLKKSMLHPSLYFDAGEIQAMRQKSRASHLHLFRAIRSAVTVMLSNPTYYLPPPKHADFAAKWNEIYGNNLPPLALYCLLCPEDKVAFEFVLEYMDRMVGYKDWLVENAPGDEVPIGHSLTGFATAFDFLYNLLDNHRRQKYLEKIWVITEEMYEYSKVRSWGKQLLHNHQATNMIALLTGALVTGVDKGSKANIWKQAVVDVMEKTMFLLNHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMEPTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 24019 - protein, 1222 aa, Homo sapiens; identical to SEQ ID NO: 24018
  Payload ID: 4796
  Gene Symbol: DSEL
  Gene Name: dermatan sulfate epimerase-like
  Uniprot ID: Q8IZU8
  ENSP ID: ENSP00000460321

SEQ ID NO: 24020 - protein, 201 aa, Homo sapiens
  Payload ID: 4797
  Gene Symbol: DPT
  Gene Name: dermatopontin
  Uniprot ID: Q07507
  ENSP ID: ENSP00000356791
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 24021 - protein, 110 aa, Homo sapiens
  Payload ID: 4798
  Gene Symbol: DCD
  Gene Name: dermcidin
  Uniprot ID: P81605
  ENSP ID: ENSP00000293371
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 24022 - protein, 121 aa, Homo sapiens
  Payload ID: 4798
  Gene Symbol: DCD
  Gene Name: dermcidin
  Uniprot ID: P81605
  ENSP ID: ENSP00000406773
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGGEERLVFGAPVNLTSIPLTSVSRP

SEQ ID NO: 24023 - protein, 77 aa, Homo sapiens
  Payload ID: 4798
  Gene Symbol: DCD
  Gene Name: dermcidin
  Uniprot ID: P81605
  ENSP ID: ENSP00000450415
MRFMTLLFLTALAGALVCAYDPEAASAPGSGNHKQMDCLQLQKPPSETAKFLSSSTNLPRREKLVPSAKPPHTRGLV

SEQ ID NO: 24024 - protein, 476 aa, Homo sapiens
  Payload ID: 4799
  Gene Symbol: DMKN
  Gene Name: dermokine
  Uniprot ID: Q6E0U4
  ENSP ID: ENSP00000342012
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24025 - protein, 99 aa, Homo sapiens
  Payload ID: 4799
  Gene Symbol: DMKN
  Gene Name: dermokine
  ENSP ID: ENSP00000376042
MLGITSCSDQQAKEGEGLEGSSTGSSSGNHGGSGGGNGHKPGCEKPGNEARGSGESGIQNSETSPGMFNFDTFWKNFKSKLGFINWDAINKDQRSSRIP

SEQ ID NO: 24026 - protein, 203 aa, Homo sapiens
  Payload ID: 4799
  Gene Symbol: DMKN
  Gene Name: dermokine
  ENSP ID: ENSP00000384509
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 24027 - protein, 90 aa, Homo sapiens
  Payload ID: 4799
  Gene Symbol: DMKN
  Gene Name: dermokine
  Uniprot ID: Q6E0U4
  ENSP ID: ENSP00000386225
MNMKPATASALLLLLLGLAWTQGSHGWGADASSLQKRAGRDDQNYNYNQHAYPTAYGGKYSVKTPAKGGVSPSSSASRVQPGLLQWVKFW

SEQ ID NO: 24028 - protein, 201 aa, Homo sapiens
  Payload ID: 4799
  Gene Symbol: DMKN
  Gene Name: dermokine
  ENSP ID: ENSP00000388378
  MOD_RES (1)..(1): Any amino acid
XGGGNGHKPGCEKPGNEARGSGESGIQGFRGQGVSSNMREISKEGNRLLGGSGDNYRNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 24029 - protein, 398 aa, Homo sapiens
  Payload ID: 4799
  Gene Symbol: DMKN
  Gene Name: dermokine
  Uniprot ID: Q6E0U4
  ENSP ID: ENSP00000388404
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMRNSETSPGMFNFDTFWKNFKSKLGFINWDAINKDQRSSRIP

SEQ ID NO: 24030 - protein, 465 aa, Homo sapiens
  Payload ID: 4799
  Gene Symbol: DMKN
  Gene Name: dermokine
  Uniprot ID: Q6E0U4
  ENSP ID: ENSP00000391036
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24031 - protein, 189 aa, Homo sapiens
  Payload ID: 4799
  Gene Symbol: DMKN
  Gene Name: dermokine
  Uniprot ID: Q6E0U4
  ENSP ID: ENSP00000392222
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24032 - protein, 436 aa, Homo sapiens
  Payload ID: 4799
  Gene Symbol: DMKN
  Gene Name: dermokine
  Uniprot ID: Q6E0U4
  ENSP ID: ENSP00000394908
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 24033 - protein, 116 aa, Homo sapiens
  Payload ID: 4799
  Gene Symbol: DMKN
  Gene Name: dermokine
  ENSP ID: ENSP00000397005
MLGITSCSDQQAKEGEGLEGSSTGSSSGNHGGSGGGNGHKPGCEKPGNEARGSGESGIQGQGSSWGSGGGDAVGGVNTVNSETSPGMFNFDTFWKNFKSKLGFINWDAINKDQRSS

SEQ ID NO: 24034 - protein, 131 aa, Homo sapiens
  Payload ID: 4799
  Gene Symbol: DMKN
  Gene Name: dermokine
  ENSP ID: ENSP00000403957
MLGITSCSDQQAKEGEGLEGSSTGSSSGNHGGSGGGNGHKPGCEKPGNEARGSGESGIQGFRGQGVSSNMRGQGSSWGSGGGDAVGGVNTVNSETSPGMFNFDTFWKNFKSKLGFINWDAINKDQRSSRIP

SEQ ID NO: 24035 - protein, 449 aa, Homo sapiens
  Payload ID: 4799
  Gene Symbol: DMKN
  Gene Name: dermokine
  Uniprot ID: Q6E0U4
  ENSP ID: ENSP00000405503
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 24036 - protein, 253 aa, Homo sapiens
  Payload ID: 4799
  Gene Symbol: DMKN
  Gene Name: dermokine
  ENSP ID: ENSP00000406864
MLGITSCSDQQAKEGEGLEGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 24037 - protein, 369 aa, Homo sapiens
  Payload ID: 4799
  Gene Symbol: DMKN
  Gene Name: dermokine
  Uniprot ID: Q6E0U4
  ENSP ID: ENSP00000409513
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGNSETSPGMFNFDTFWKNFKSKLGFINWDAINKDQRSSRIP

SEQ ID NO: 24038 - protein, 172 aa, Homo sapiens
  Payload ID: 4799
  Gene Symbol: DMKN
  Gene Name: dermokine
  ENSP ID: ENSP00000412075
MLGITSCSDQQAKEGEGLEGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24039 - protein, 386 aa, Homo sapiens
  Payload ID: 4799
  Gene Symbol: DMKN
  Gene Name: dermokine
  Uniprot ID: Q6E0U4
  ENSP ID: ENSP00000414743
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKDQRSSRIP

SEQ ID NO: 24040 - protein, 36 aa, Homo sapiens
  Payload ID: 4799
  Gene Symbol: DMKN
  Gene Name: dermokine
  ENSP ID: ENSP00000468840
MLGITSCSDQQAKEGEGIQHRLLLRQPRWERRRKWT

SEQ ID NO: 24041 - protein, 36 aa, Homo sapiens; identical to SEQ ID NO: 24040
  Payload ID: 4799
  Gene Symbol: DMKN
  Gene Name: dermokine
  ENSP ID: ENSP00000468987

SEQ ID NO: 24042 - protein, 36 aa, Homo sapiens; identical to SEQ ID NO: 24040
  Payload ID: 4799
  Gene Symbol: DMKN
  Gene Name: dermokine
  ENSP ID: ENSP00000469824

SEQ ID NO: 24043 - protein, 36 aa, Homo sapiens; identical to SEQ ID NO: 24040
  Payload ID: 4799
  Gene Symbol: DMKN
  Gene Name: dermokine
  ENSP ID: ENSP00000469845

SEQ ID NO: 24044 - protein, 36 aa, Homo sapiens; identical to SEQ ID NO: 24040
  Payload ID: 4799
  Gene Symbol: DMKN
  Gene Name: dermokine
  ENSP ID: ENSP00000469923

SEQ ID NO: 24045 - protein, 36 aa, Homo sapiens; identical to SEQ ID NO: 24040
  Payload ID: 4799
  Gene Symbol: DMKN
  Gene Name: dermokine
  ENSP ID: ENSP00000470033

SEQ ID NO: 24046 - protein, 36 aa, Homo sapiens; identical to SEQ ID NO: 24040
  Payload ID: 4799
  Gene Symbol: DMKN
  Gene Name: dermokine
  ENSP ID: ENSP00000470425

SEQ ID NO: 24047 - protein, 36 aa, Homo sapiens; identical to SEQ ID NO: 24040
  Payload ID: 4799
  Gene Symbol: DMKN
  Gene Name: dermokine
  ENSP ID: ENSP00000470510

SEQ ID NO: 24048 - protein, 36 aa, Homo sapiens; identical to SEQ ID NO: 24040
  Payload ID: 4799
  Gene Symbol: DMKN
  Gene Name: dermokine
  ENSP ID: ENSP00000470775

SEQ ID NO: 24049 - protein, 36 aa, Homo sapiens; identical to SEQ ID NO: 24040
  Payload ID: 4799
  Gene Symbol: DMKN
  Gene Name: dermokine
  ENSP ID: ENSP00000470881

SEQ ID NO: 24050 - protein, 201 aa, Homo sapiens
  Payload ID: 4799
  Gene Symbol: DMKN
  Gene Name: dermokine
  ENSP ID: ENSP00000471112
MLGITSCSDQQAKEGEGLEGSSTGSSSGNHGGSGGGNGHKPGCEKPGNEARGSGESGIQGFRGQGVSSNMRNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24051 - protein, 36 aa, Homo sapiens; identical to SEQ ID NO: 24040
  Payload ID: 4799
  Gene Symbol: DMKN
  Gene Name: dermokine
  ENSP ID: ENSP00000471288

SEQ ID NO: 24052 - protein, 36 aa, Homo sapiens; identical to SEQ ID NO: 24040
  Payload ID: 4799
  Gene Symbol: DMKN
  Gene Name: dermokine
  ENSP ID: ENSP00000471451

SEQ ID NO: 24053 - protein, 108 aa, Homo sapiens
  Payload ID: 4799
  Gene Symbol: DMKN
  Gene Name: dermokine
  ENSP ID: ENSP00000471487
  MOD_RES (1)..(1): Any amino acid
XPATASALLLLLLGLAWTQGSHGWVGTAGCTGCGRVITAETCRQRRSELQLQPACVSHCLWWEVLSQDPCKGGSLTFFLGFPGATWPAAVGEVLVGNFLQPPPRPRKA

SEQ ID NO: 24054 - protein, 36 aa, Homo sapiens; identical to SEQ ID NO: 24040
  Payload ID: 4799
  Gene Symbol: DMKN
  Gene Name: dermokine
  ENSP ID: ENSP00000471670

SEQ ID NO: 24055 - protein, 74 aa, Homo sapiens
  Payload ID: 4799
  Gene Symbol: DMKN
  Gene Name: dermokine
  ENSP ID: ENSP00000471968
  MOD_RES (1)..(1): Any amino acid
XALLLLLLGLAWTQGSHGWGADASSLQKRAGRDDQNYNYNQHAYPTAYGGKYSVKTPAKASRVQPGLLQWVKFW

SEQ ID NO: 24056 - protein, 36 aa, Homo sapiens; identical to SEQ ID NO: 24040
  Payload ID: 4799
  Gene Symbol: DMKN
  Gene Name: dermokine
  ENSP ID: ENSP00000472127

SEQ ID NO: 24057 - protein, 36 aa, Homo sapiens; identical to SEQ ID NO: 24040
  Payload ID: 4799
  Gene Symbol: DMKN
  Gene Name: dermokine
  ENSP ID: ENSP00000472262

SEQ ID NO: 24058 - protein, 36 aa, Homo sapiens; identical to SEQ ID NO: 24040
  Payload ID: 4799
  Gene Symbol: DMKN
  Gene Name: dermokine
  ENSP ID: ENSP00000472344

SEQ ID NO: 24059 - protein, 184 aa, Homo sapiens
  Payload ID: 4799
  Gene Symbol: DMKN
  Gene Name: dermokine
  ENSP ID: ENSP00000472349
MLGITSCSDQQAKEGEGLEGSSTGSSSGNHGGSGGGNGHKPGCEKPGNEARGSGESGIQNSETSPGMFNFDTFWKNFKSKLGFINWDAINKDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 24060 - protein, 82 aa, Homo sapiens
  Payload ID: 4799
  Gene Symbol: DMKN
  Gene Name: dermokine
  ENSP ID: ENSP00000473191
MLGITSCSDQQAKEGEGLEGSSTGSSSGNHGGSGGGNGHKPGNSETSPGMFNFDTFWKNFKSKLGFINWDAINKDQRSSRIP

SEQ ID NO: 24061 - protein, 94 aa, Homo sapiens
  Payload ID: 4799
  Gene Symbol: DMKN
  Gene Name: dermokine
  ENSP ID: ENSP00000473296
MFNFDTFWKNFKSKLGFINWDAINKNQVPPPSTRALLYFSRLWEDFKQNTPFLNWKAIIEGADASSLQKRAGRDDQNYNYNQHAYPTAYGGKYS

SEQ ID NO: 24062 - protein, 123 aa, Homo sapiens
  Payload ID: 4799
  Gene Symbol: DMKN
  Gene Name: dermokine
  Uniprot ID: Q6E0U4
  ENSP ID: ENSP00000473341
MFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24063 - protein, 203 aa, Homo sapiens; identical to SEQ ID NO: 24026
  Payload ID: 4799
  Gene Symbol: DMKN
  Gene Name: dermokine
  ENSP ID: ENSP00000473526

SEQ ID NO: 24064 - protein, 96 aa, Homo sapiens
  Payload ID: 4799
  Gene Symbol: DMKN
  Gene Name: dermokine
  ENSP ID: ENSP00000473734
  MOD_RES (1)..(1): Any amino acid
XPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24065 - protein, 33 aa, Homo sapiens
  Payload ID: 4799
  Gene Symbol: DMKN
  Gene Name: dermokine
  ENSP ID: ENSP00000474098
MFNFDTFWKNFKSKLGFINWDAINKDQRSSRIP

SEQ ID NO: 24066 - protein, 33 aa, Homo sapiens; identical to SEQ ID NO: 24065
  Payload ID: 4799
  Gene Symbol: DMKN
  Gene Name: dermokine
  ENSP ID: ENSP00000474123

SEQ ID NO: 24067 - protein, 123 aa, Homo sapiens; identical to SEQ ID NO: 24062
  Payload ID: 4799
  Gene Symbol: DMKN
  Gene Name: dermokine
  Uniprot ID: Q6E0U4
  ENSP ID: ENSP00000474419

SEQ ID NO: 24068 - protein, 152 aa, Homo sapiens
  Payload ID: 4799
  Gene Symbol: DMKN
  Gene Name: dermokine
  ENSP ID: ENSP00000474491
SSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 24069 - protein, 36 aa, Homo sapiens
  Payload ID: 4799
  Gene Symbol: DMKN
  Gene Name: dermokine
  ENSP ID: ENSP00000474995
SGNHGGSGGGNGHKPGISRLWLTKWVLLSSHISLVP

SEQ ID NO: 24070 - protein, 36 aa, Homo sapiens; identical to SEQ ID NO: 24040
  Payload ID: 4799
  Gene Symbol: DMKN
  Gene Name: dermokine
  ENSP ID: ENSP00000476043

SEQ ID NO: 24071 - protein, 396 aa, Homo sapiens
  Payload ID: 4800
  Gene Symbol: DHH
  Gene Name: desert hedgehog
  Uniprot ID: O43323
  ENSP ID: ENSP00000266991
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 24072 - protein, 470 aa, Homo sapiens
  Payload ID: 4801
  Gene Symbol: DES
  Gene Name: desmin
  Uniprot ID: P17661
  ENSP ID: ENSP00000363071
MSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 24073 - protein, 840 aa, Homo sapiens
  Payload ID: 4802
  Gene Symbol: DSC1
  Gene Name: desmocollin 1
  Uniprot ID: Q08554
  ENSP ID: ENSP00000257197
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEESIRGHTLIKN

SEQ ID NO: 24074 - protein, 894 aa, Homo sapiens
  Payload ID: 4802
  Gene Symbol: DSC1
  Gene Name: desmocollin 1
  Uniprot ID: Q08554
  ENSP ID: ENSP00000257198
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 24075 - protein, 847 aa, Homo sapiens
  Payload ID: 4803
  Gene Symbol: DSC2
  Gene Name: desmocollin 2
  Uniprot ID: Q02487
  ENSP ID: ENSP00000251081
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEESIRGHTLIKN

SEQ ID NO: 24076 - protein, 901 aa, Homo sapiens
  Payload ID: 4803
  Gene Symbol: DSC2
  Gene Name: desmocollin 2
  Uniprot ID: Q02487
  ENSP ID: ENSP00000280904
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 24077 - protein, 896 aa, Homo sapiens
  Payload ID: 4804
  Gene Symbol: DSC3
  Gene Name: desmocollin 3
  Uniprot ID: Q14574
  ENSP ID: ENSP00000353608
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 24078 - protein, 839 aa, Homo sapiens
  Payload ID: 4804
  Gene Symbol: DSC3
  Gene Name: desmocollin 3
  Uniprot ID: Q14574
  ENSP ID: ENSP00000392068
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEESIRGHTG

SEQ ID NO: 24079 - protein, 214 aa, Homo sapiens
  Payload ID: 4804
  Gene Symbol: DSC3
  Gene Name: desmocollin 3
  ENSP ID: ENSP00000464283
  MOD_RES (1)..(1): Any amino acid
XKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEESIRGHTG

SEQ ID NO: 24080 - protein, 1049 aa, Homo sapiens
  Payload ID: 4805
  Gene Symbol: DSG1
  Gene Name: desmoglein 1
  Uniprot ID: Q02413
  ENSP ID: ENSP00000257192
MDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 24081 - protein, 408 aa, Homo sapiens
  Payload ID: 4805
  Gene Symbol: DSG1
  Gene Name: desmoglein 1
  Uniprot ID: Q02413
  ENSP ID: ENSP00000462666
MQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 24082 - protein, 1118 aa, Homo sapiens
  Payload ID: 4806
  Gene Symbol: DSG2
  Gene Name: desmoglein 2
  Uniprot ID: Q14126
  ENSP ID: ENSP00000261590
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 24083 - protein, 232 aa, Homo sapiens
  Payload ID: 4806
  Gene Symbol: DSG2
  Gene Name: desmoglein 2
  ENSP ID: ENSP00000462503
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREVS

SEQ ID NO: 24084 - protein, 999 aa, Homo sapiens
  Payload ID: 4807
  Gene Symbol: DSG3
  Gene Name: desmoglein 3
  Uniprot ID: P32926
  ENSP ID: ENSP00000257189
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSTSGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 24085 - protein, 1040 aa, Homo sapiens
  Payload ID: 4808
  Gene Symbol: DSG4
  Gene Name: desmoglein 4
  Uniprot ID: Q86SJ6
  ENSP ID: ENSP00000311859
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRDVSNICAPMTASNTQDRMDSSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 24086 - protein, 1059 aa, Homo sapiens
  Payload ID: 4808
  Gene Symbol: DSG4
  Gene Name: desmoglein 4
  Uniprot ID: Q86SJ6
  ENSP ID: ENSP00000352785
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRLFSAYALPGGGGTADGGGSVLGRCALQATPALLNQHPPFSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 24087 - protein, 2871 aa, Homo sapiens
  Payload ID: 4809
  Gene Symbol: DSP
  Gene Name: desmoplakin
  Uniprot ID: P15924
  ENSP ID: ENSP00000369129
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 24088 - protein, 2272 aa, Homo sapiens
  Payload ID: 4809
  Gene Symbol: DSP
  Gene Name: desmoplakin
  Uniprot ID: P15924
  ENSP ID: ENSP00000396591
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 24089 - protein, 165 aa, Homo sapiens
  Payload ID: 4810
  Gene Symbol: DSTN
  Gene Name: destrin (actin depolymerizing factor)
  Uniprot ID: P60981
  ENSP ID: ENSP00000246069
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 24090 - protein, 135 aa, Homo sapiens
  Payload ID: 4810
  Gene Symbol: DSTN
  Gene Name: destrin (actin depolymerizing factor)
  ENSP ID: ENSP00000434355
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGKCTHS

SEQ ID NO: 24091 - protein, 148 aa, Homo sapiens
  Payload ID: 4810
  Gene Symbol: DSTN
  Gene Name: destrin (actin depolymerizing factor)
  Uniprot ID: P60981
  ENSP ID: ENSP00000476975
MKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 24092 - protein, 168 aa, Homo sapiens
  Payload ID: 4811
  Gene Symbol: DESI1
  Gene Name: desumoylating isopeptidase 1
  Uniprot ID: Q6ICB0
  ENSP ID: ENSP00000263256
MEPPNLYPVKLYVYDLSKGLARRLSPIMLGKQLEGIWHTSIVVHKDEFFFGSGGISSCPPGGTLLGPPDSVVDVGSTEVTEEIFLEYLSSLGESLFRGEAYNLFEHNCNTFSNEVAQFLTGRKIPSYITDLPSEVLSTPFGQALRPLLDSIQIQPPGGSSVGRPNGQS

SEQ ID NO: 24093 - protein, 161 aa, Homo sapiens
  Payload ID: 4812
  Gene Symbol: DESI2
  Gene Name: desumoylating isopeptidase 2
  Uniprot ID: Q9BSY9
  ENSP ID: ENSP00000263831
MGANQLVVLNVYDMYWMNEYTSSIGIGVFHSGIEVYGRAVVLGSTDFLEDDIEKIVEELGKEYKGNAYHLMHKNCNHFSSALSEILCGKEIPRWINRLAYFSSCIPFLQSCLPKEWLTPAALQSSVSQELQDELEEAEDAAASASVASTAAGSRPGRHTKL

SEQ ID NO: 24094 - protein, 194 aa, Homo sapiens
  Payload ID: 4812
  Gene Symbol: DESI2
  Gene Name: desumoylating isopeptidase 2
  Uniprot ID: Q9BSY9
  ENSP ID: ENSP00000306528
MGANQLVVLNVYDMYWMNEYTSSIGIGVFHSGIEVYGREFAYGGHPYPFSGIFEISPGNASELGETFKFKEAVVLGSTDFLEDDIEKIVEELGKEYKGNAYHLMHKNCNHFSSALSEILCGKEIPRWINRLAYFSSCIPFLQSCLPKEWLTPAALQSSVSQELQDELEEAEDAAASASVASTAAGSRPGRHTKL

SEQ ID NO: 24095 - protein, 101 aa, Homo sapiens
  Payload ID: 4812
  Gene Symbol: DESI2
  Gene Name: desumoylating isopeptidase 2
  ENSP ID: ENSP00000394555
MRLTFLKKIAQLNYLEILVVLLSYTLKTTFQYWMNEYTSSIGIGVFHSGIEVYGREFAYGGHPYPFSGIFEISPGNASELGETFKFKEAVVLGSTDFLEDD

SEQ ID NO: 24096 - protein, 102 aa, Homo sapiens
  Payload ID: 4813
  Gene Symbol: DDA1
  Gene Name: DET1 and DDB1 associated 1
  Uniprot ID: Q9BW61
  ENSP ID: ENSP00000352928
MADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 24097 - protein, 102 aa, Homo sapiens; identical to SEQ ID NO: 24096
  Payload ID: 4813
  Gene Symbol: DDA1
  Gene Name: DET1 and DDB1 associated 1
  Uniprot ID: Q9BW61
  ENSP ID: ENSP00000472171

SEQ ID NO: 24098 - protein, 102 aa, Homo sapiens; identical to SEQ ID NO: 24096
  Payload ID: 4813
  Gene Symbol: DDA1
  Gene Name: DET1 and DDB1 associated 1
  Uniprot ID: Q9BW61
  ENSP ID: ENSP00000473086

SEQ ID NO: 24099 - protein, 343 aa, Homo sapiens
  Payload ID: 4814
  Gene Symbol: DBX1
  Gene Name: developing brain homeobox 1
  Uniprot ID: A6NMT0
  ENSP ID: ENSP00000436881
MMFPGLLAPPAGYPSLLRPTPTLTLPQSLQSAFSGHSSFLVEDLIRISRPPAYLPRSVPTASMSPPRQGAPTALTDTGASDLGSPGPGSRRGGSPPTAFSPASETTFLKFGVNAILSSGPRTETSPALLQSVPPKTFAFPYFEGSFQPFIRSSYFPASSSVVPIPGTFSWPLAARGKPRRGMLRRAVFSDVQRKALEKMFQKQKYISKPDRKKLAAKLGLKDSQVKIWFQNRRMKWRNSKERELLSSGGCREQTLPTKLNPHPDLSDVGQKGPGNEEEEEGPGSPSHRLAYHASSDPQHLRDPRLPGPLPPSPAHSSSPGKPSDFSDSEEEEEGEEQEEITVS

SEQ ID NO: 24100 - protein, 339 aa, Homo sapiens
  Payload ID: 4815
  Gene Symbol: DBX2
  Gene Name: developing brain homeobox 2
  Uniprot ID: Q6ZNG2
  ENSP ID: ENSP00000331470
MLPSAVAAHAGAYWDVVASSALLNLPAAPGFGNLGKSFLIENLLRVGGAPTPRLQPPAPHDPATALATAGAQLRPLPASPVPLKLCPAAEQVSPAGAPYGTRWAFQVLSPSADSARLPGRAPGDRDCTFQPSAPAPSKPFLLSTPPFYSACCGGSCRRPASSTAFPREESMLPLLTQDSNSKARRGILRRAVFSEDQRKALEKMFQKQKYISKTDRKKLAINLGLKESQVKIWFQNRRMKWRNSKEKEVLSNRCIQEVGLQEDPLSRSALGFPSPCPSIWDVPQQHSSPRWRENSPEPSERLIQESSGAPPPEANSLQGALYLCSEEEAGSKGVLTGAV

SEQ ID NO: 24101 - protein, 298 aa, Homo sapiens
  Payload ID: 4816
  Gene Symbol: DPPA2
  Gene Name: developmental pluripotency associated 2
  Uniprot ID: Q7Z7J5
  ENSP ID: ENSP00000417710
MSDANLDSSKKNFLEGEVDDEESVILTLVPVKDDANMEQMEPSVSSTSDVKLEKPKKYNPGHLLQTNEQFTAPQKARCKIPALPLPTILPPINKVCRDTLRDWCQQLGLSTNGKKIEVYLRLHRHAYPEQRQDMPEMSQETRLQRCSRKRKAVTKRARLQRSYEMNERAEETNTVEVITSAPGAMLASWARIAARAVQPKALNSCSIPVSVEAFLMQASGVRWCVVHGRLLSADTKGWVRLQFHAGQAWVPTTHRRMISLFLLPACIFPSPGIEDNMLCPDCAKRNKKMMKRLMTVEK

SEQ ID NO: 24102 - protein, 159 aa, Homo sapiens
  Payload ID: 4817
  Gene Symbol: DPPA3
  Gene Name: developmental pluripotency associated 3
  Uniprot ID: Q6W0C5
  ENSP ID: ENSP00000339250
MDPSQFNPTYIPGSPQMLTEENSRDDSGASQISSETLIKNLSNLTINASSESVSPLSEALLRRESVGAAVLREIEDEWLYSRRGVRTLLSVQREKMARLRYMLLGGVRTHERRPTNKEPKGVKKESRPFKCPCSFCVSNGWDPSENARIGNQDTKPLQP

SEQ ID NO: 24103 - protein, 304 aa, Homo sapiens
  Payload ID: 4818
  Gene Symbol: DPPA4
  Gene Name: developmental pluripotency associated 4
  Uniprot ID: Q7L190
  ENSP ID: ENSP00000335306
MLRGSASSTSMEKAKGKEWTSTEKSREEDQQASNQPNSIALPGTSAKRTKEKMSIKGSKVLCPKKKAEHTDNPRPQKKIPIPPLPSKLPPVNLIHRDILRAWCQQLKLSSKGQKLDAYKRLCAFAYPNQKDFPSTAKEAKIRKSLQKKLKVEKGETSLQSSETHPPEVALPPVGEPPALENSTALLEGVNTVVVTTSAPEALLASWARISARARTPEAVESPQEASGVRWCVVHGKSLPADTDGWVHLQFHAGQAWVPEKQEGRVSALFLLPASNFPPPHLEDNMLCPKCVHRNKVLIKSLQWE

SEQ ID NO: 24104 - protein, 35 aa, Homo sapiens
  Payload ID: 4818
  Gene Symbol: DPPA4
  Gene Name: developmental pluripotency associated 4
  ENSP ID: ENSP00000418313
MSIKGSKVLCPKKKAEHTDNPRPQKKIPIPPLPSK

SEQ ID NO: 24105 - protein, 68 aa, Homo sapiens
  Payload ID: 4818
  Gene Symbol: DPPA4
  Gene Name: developmental pluripotency associated 4
  ENSP ID: ENSP00000420581
MLRGSASSTSMEKAKGKEEHQQREPKKKCLSKAVKCSALRKRQSTLTTPDLRRRYQSLHYLLNCHLLI

SEQ ID NO: 24106 - protein, 116 aa, Homo sapiens
  Payload ID: 4819
  Gene Symbol: DPPA5
  Gene Name: developmental pluripotency associated 5
  Uniprot ID: A6NC42
  ENSP ID: ENSP00000359396
MGTLPARRHIPPWVKVPEDLKDPEVFQVQTRLLKAIFGPDGSRIPYIEQVSKAMLELKALESSDLTEVVVYGSYLYKLRTKWMLQSMAEWHRQRQERGMLKLAEAMNALELGPWMK

SEQ ID NO: 24107 - protein, 367 aa, Homo sapiens
  Payload ID: 4820
  Gene Symbol: DRG1
  Gene Name: developmentally regulated GTP binding protein 1
  Uniprot ID: Q9Y295
  ENSP ID: ENSP00000329715
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 24108 - protein, 63 aa, Homo sapiens
  Payload ID: 4820
  Gene Symbol: DRG1
  Gene Name: developmentally regulated GTP binding protein 1
  ENSP ID: ENSP00000408091
MSSTLAKIAEIEAEMARTQKNKATAHHLGLLKARLAKLRRELITPKGGGGGGPGEAPGSPRYH

SEQ ID NO: 24109 - protein, 56 aa, Homo sapiens
  Payload ID: 4820
  Gene Symbol: DRG1
  Gene Name: developmentally regulated GTP binding protein 1
  ENSP ID: ENSP00000448252
  MOD_RES (1)..(1): Any amino acid
XLLEKIWDYLKLVRIYTKPKGQLPDYTSPVVLPYSRTTVEDFCMKIHKNLIKEFKY

SEQ ID NO: 24110 - protein, 364 aa, Homo sapiens
  Payload ID: 4821
  Gene Symbol: DRG2
  Gene Name: developmentally regulated GTP binding protein 2
  Uniprot ID: P55039
  ENSP ID: ENSP00000225729
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 24111 - protein, 343 aa, Homo sapiens
  Payload ID: 4821
  Gene Symbol: DRG2
  Gene Name: developmentally regulated GTP binding protein 2
  ENSP ID: ENSP00000379076
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKAPAPSTVRSGWA

SEQ ID NO: 24112 - protein, 113 aa, Homo sapiens
  Payload ID: 4821
  Gene Symbol: DRG2
  Gene Name: developmentally regulated GTP binding protein 2
  ENSP ID: ENSP00000462060
MGILEKISEIEKEIARTQKNKATEYHLGLLKAKLAKYRAQLLEPSKSASSKGEGFDVMKSGDARVALIGFPSVGKPKKGGGISFNSTVTLTQCSEKLVQLILHEYKIFNAEVL

SEQ ID NO: 24113 - protein, 90 aa, Homo sapiens
  Payload ID: 4821
  Gene Symbol: DRG2
  Gene Name: developmentally regulated GTP binding protein 2
  ENSP ID: ENSP00000462978
MGILEKISEIEKEIARTQKNKATEYHLGLLKAKLAKYRAQLLEPSKSASSKGEGFDVMKSGDARVALIGFPSVVHILESDDLHGQRGSVL

SEQ ID NO: 24114 - protein, 161 aa, Homo sapiens
  Payload ID: 4821
  Gene Symbol: DRG2
  Gene Name: developmentally regulated GTP binding protein 2
  ENSP ID: ENSP00000463256
MGILEKISEIEKEIARTQKNKATEYHLGLLKAKLAKYRAQLLEPSKSASSKGEGFDVMKSGDARVALIGFPSVGKLRHEAEPGLSAGDALGVLGPDLHLHQEERTEARLHRRHHSPERGLSGARVPPHPPVTRQPVQVRPGVGHQHQVQSAAGGPDPHHGA

SEQ ID NO: 24115 - protein, 244 aa, Homo sapiens
  Payload ID: 4821
  Gene Symbol: DRG2
  Gene Name: developmentally regulated GTP binding protein 2
  ENSP ID: ENSP00000463268
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYNLQCRSAFPRRLLPGRVHRCDRGQPGVHALPVCL

SEQ ID NO: 24116 - protein, 112 aa, Homo sapiens
  Payload ID: 4821
  Gene Symbol: DRG2
  Gene Name: developmentally regulated GTP binding protein 2
  ENSP ID: ENSP00000463436
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEEKAVAGR

SEQ ID NO: 24117 - protein, 90 aa, Homo sapiens; identical to SEQ ID NO: 24113
  Payload ID: 4821
  Gene Symbol: DRG2
  Gene Name: developmentally regulated GTP binding protein 2
  ENSP ID: ENSP00000463522

SEQ ID NO: 24118 - protein, 22 aa, Homo sapiens
  Payload ID: 4821
  Gene Symbol: DRG2
  Gene Name: developmentally regulated GTP binding protein 2
  ENSP ID: ENSP00000463747
MGILEKISEIEKEIARTQKNKD

SEQ ID NO: 24119 - protein, 90 aa, Homo sapiens; identical to SEQ ID NO: 24113
  Payload ID: 4821
  Gene Symbol: DRG2
  Gene Name: developmentally regulated GTP binding protein 2
  ENSP ID: ENSP00000464004

SEQ ID NO: 24120 - protein, 158 aa, Homo sapiens
  Payload ID: 4821
  Gene Symbol: DRG2
  Gene Name: developmentally regulated GTP binding protein 2
  ENSP ID: ENSP00000464076
MGILEKISEIEKEIARTQKNKATEYHLGLLKAKLAKYRAQLLEPSKSASSKGEGFDVMKSGDARVALIGFPSVGKFHSCCPSWSTMARSQLTTTSASQSTFLSLMTSTASEAASYEFTTLTCIPGVIEYKGANIQLLDLPGIIEGAAQGKGRGRQVIA

SEQ ID NO: 24121 - protein, 172 aa, Homo sapiens
  Payload ID: 4821
  Gene Symbol: DRG2
  Gene Name: developmentally regulated GTP binding protein 2
  ENSP ID: ENSP00000464244
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVSAGEGAGVCGHPPQQAQA

SEQ ID NO: 24122 - protein, 678 aa, Homo sapiens
  Payload ID: 4822
  Gene Symbol: DHX58
  Gene Name: DEXH (Asp-Glu-X-His) box polypeptide 58
  Uniprot ID: Q96C10
  ENSP ID: ENSP00000251642
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDALAALQDFYHREHVTKTQILCAERRLLALFDDRKNELAHLATHGPENPKLEMLEKILQRQFSSSNSPRGIIFTRTRQSAHSLLLWLQQQQGLQTVDIRAQLLIGAGNSSQSTHMTQRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKIRDLQQAALTKRAAQAAQRENQRQQFPVEHVQLLCINCMVAVGHGSDLRKVEGTHHVNVNPNFSNYYNVSRDPVVINKVFKDWKPGGVISCRNCGEVWGLQMIYKSVKLPVLKVRSMLLETPQGRIQAKKWSRVPFSVPDFDFLQHCAENLSDLSLD

SEQ ID NO: 24123 - protein, 156 aa, Homo sapiens
  Payload ID: 4822
  Gene Symbol: DHX58
  Gene Name: DEXH (Asp-Glu-X-His) box polypeptide 58
  ENSP ID: ENSP00000404639
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQR

SEQ ID NO: 24124 - protein, 302 aa, Homo sapiens
  Payload ID: 4822
  Gene Symbol: DHX58
  Gene Name: DEXH (Asp-Glu-X-His) box polypeptide 58
  ENSP ID: ENSP00000416389
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDA

SEQ ID NO: 24125 - protein, 99 aa, Homo sapiens
  Payload ID: 4822
  Gene Symbol: DHX58
  Gene Name: DEXH (Asp-Glu-X-His) box polypeptide 58
  ENSP ID: ENSP00000466721
MLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTA

SEQ ID NO: 24126 - protein, 51 aa, Homo sapiens
  Payload ID: 4822
  Gene Symbol: DHX58
  Gene Name: DEXH (Asp-Glu-X-His) box polypeptide 58
  ENSP ID: ENSP00000467470
  MOD_RES (1)..(1): Any amino acid
XDQSVYAFVATEGSRELKRELINEALETLMEQAVAAVQKMDQAEYQAKELL

SEQ ID NO: 24127 - protein, 95 aa, Homo sapiens
  Payload ID: 4823
  Gene Symbol: DEXI
  Gene Name: Dexi homolog (mouse)
  Uniprot ID: O95424
  ENSP ID: ENSP00000330509
MLGARVAAHLDALGPLVPYVPPPLLPSMFYVGLFFVNVLILYYAFLMEYIVLNVGLVFLPEDMDQALVDLGVLSDPGSGLYDADSELDVFDAYLE

SEQ ID NO: 24128 - protein, 95 aa, Homo sapiens; identical to SEQ ID NO: 24127
  Payload ID: 4823
  Gene Symbol: DEXI
  Gene Name: Dexi homolog (mouse)
  Uniprot ID: O95424
  ENSP ID: ENSP00000482265

SEQ ID NO: 24129 - protein, 773 aa, Homo sapiens
  Payload ID: 4824
  Gene Symbol: DGCR8
  Gene Name: DGCR8 microprocessor complex subunit
  Uniprot ID: Q8WYQ5
  ENSP ID: ENSP00000263209
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECENPSEPFGASVTIDGVTYGSGTASSKKLAKNKAARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 24130 - protein, 740 aa, Homo sapiens
  Payload ID: 4824
  Gene Symbol: DGCR8
  Gene Name: DGCR8 microprocessor complex subunit
  Uniprot ID: Q8WYQ5
  ENSP ID: ENSP00000372488
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEDDFDNDVDALLEEGLCAPKKRRTEEKYGGDSDHPSDGETSVQPMMTKIKTVLKSRGRPPTEPLPDGWIMTFHNSGVPVYLHRESRVVTWSRPYFLGTGSIRKHDPPLSSIPCLHYKKMKDNEEREQSSDLTPSGDVSPVKPLSRSAELEFPLDEPDSMGADPGPPDEKDPLGAEAAPGALGQVKAKVEVCKDESVDLEEFRSYLEKRFDFEQVTVKKFRTWAERRQFNREMKRKQAESERPILPANQKLITLSVQDAPTKKEFVINPNGKSEVCILHEYMQRVLKVRPVYNFFECARATLEILIPDFVKQTSEEKPKDSEELEYFNHISIEDSRVYELTSKAGLLSPYQILHECLKRNHGMGDTSIKFEVVPGKNQKSEYVMACGKHTVRGWCKNKRVGKQLASQKILQLLHPHVKNWGSLLRMYGRESSKMVKQETSDKSVIELQQYAKKNKPNLHILSKLQEEMKRLAEEREETRKKPKMSIVASAQPGGEPLCTVDV

SEQ ID NO: 24131 - protein, 740 aa, Homo sapiens; identical to SEQ ID NO: 24130
  Payload ID: 4824
  Gene Symbol: DGCR8
  Gene Name: DGCR8 microprocessor complex subunit
  Uniprot ID: Q8WYQ5
  ENSP ID: ENSP00000384726

SEQ ID NO: 24132 - protein, 125 aa, Homo sapiens
  Payload ID: 4824
  Gene Symbol: DGCR8
  Gene Name: DGCR8 microprocessor complex subunit
  ENSP ID: ENSP00000409625
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFT

SEQ ID NO: 24133 - protein, 186 aa, Homo sapiens
  Payload ID: 4825
  Gene Symbol: DIABLO
  Gene Name: diablo, IAP-binding mitochondrial protein
  Uniprot ID: Q9NR28
  ENSP ID: ENSP00000267169
MKSDFYFQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 24134 - protein, 195 aa, Homo sapiens
  Payload ID: 4825
  Gene Symbol: DIABLO
  Gene Name: diablo, IAP-binding mitochondrial protein
  Uniprot ID: Q9NR28
  ENSP ID: ENSP00000320343
MAALKSWLSRSVTSFFRYRQCLCVPVVANFKKRCFSELIRPWHKTVTIGFGVTLCAVPIAQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 24135 - protein, 46 aa, Homo sapiens
  Payload ID: 4825
  Gene Symbol: DIABLO
  Gene Name: diablo, IAP-binding mitochondrial protein
  ENSP ID: ENSP00000339963
MAALKSWLSRSVTSFFRFLLGSSLSLQPLQVNPRACYRLAVVPYEI

SEQ ID NO: 24136 - protein, 191 aa, Homo sapiens
  Payload ID: 4825
  Gene Symbol: DIABLO
  Gene Name: diablo, IAP-binding mitochondrial protein
  ENSP ID: ENSP00000390103
  MOD_RES (1)..(1): Any amino acid
XALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTECQLNPDLNIEVEVSLQR

SEQ ID NO: 24137 - protein, 120 aa, Homo sapiens
  Payload ID: 4825
  Gene Symbol: DIABLO
  Gene Name: diablo, IAP-binding mitochondrial protein
  ENSP ID: ENSP00000390818
  MOD_RES (1)..(1): Any amino acid
XAVYTLTSLYRQYTSLLGKMNSEEEDEVWQVIIGARAEMTSKHQEYLKLETTWMTAVGLSEMAAEAAYQTEVFSSKLEEEDACHSPLPVNIVLKVLVNAVRSKCSTDELIKCIYPDGEIH

SEQ ID NO: 24138 - protein, 239 aa, Homo sapiens
  Payload ID: 4825
  Gene Symbol: DIABLO
  Gene Name: diablo, IAP-binding mitochondrial protein
  Uniprot ID: Q9NR28
  ENSP ID: ENSP00000398495
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 24139 - protein, 166 aa, Homo sapiens
  Payload ID: 4825
  Gene Symbol: DIABLO
  Gene Name: diablo, IAP-binding mitochondrial protein
  ENSP ID: ENSP00000411638
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 24140 - protein, 77 aa, Homo sapiens
  Payload ID: 4825
  Gene Symbol: DIABLO
  Gene Name: diablo, IAP-binding mitochondrial protein
  ENSP ID: ENSP00000438710
MRRAVSLVTDSTSTFLSQTTYALIEAITEYTKAVYTLTSLYRQYTSLLGKMNSEEEDEVWQVIIGARAEMTSKHQEY

SEQ ID NO: 24141 - protein, 125 aa, Homo sapiens
  Payload ID: 4825
  Gene Symbol: DIABLO
  Gene Name: diablo, IAP-binding mitochondrial protein
  ENSP ID: ENSP00000440653
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVH

SEQ ID NO: 24142 - protein, 133 aa, Homo sapiens
  Payload ID: 4825
  Gene Symbol: DIABLO
  Gene Name: diablo, IAP-binding mitochondrial protein
  ENSP ID: ENSP00000440971
MKSDFYFQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAES

SEQ ID NO: 24143 - protein, 128 aa, Homo sapiens
  Payload ID: 4825
  Gene Symbol: DIABLO
  Gene Name: diablo, IAP-binding mitochondrial protein
  ENSP ID: ENSP00000441139
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLS

SEQ ID NO: 24144 - protein, 186 aa, Homo sapiens; identical to SEQ ID NO: 24133
  Payload ID: 4825
  Gene Symbol: DIABLO
  Gene Name: diablo, IAP-binding mitochondrial protein
  Uniprot ID: Q9NR28
  ENSP ID: ENSP00000442360

SEQ ID NO: 24145 - protein, 156 aa, Homo sapiens
  Payload ID: 4825
  Gene Symbol: DIABLO
  Gene Name: diablo, IAP-binding mitochondrial protein
  ENSP ID: ENSP00000442669
MRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAE

SEQ ID NO: 24146 - protein, 735 aa, Homo sapiens
  Payload ID: 4826
  Gene Symbol: DGKA
  Gene Name: diacylglycerol kinase, alpha 80kDa
  Uniprot ID: P23743
  ENSP ID: ENSP00000328405
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 24147 - protein, 735 aa, Homo sapiens; identical to SEQ ID NO: 24146
  Payload ID: 4826
  Gene Symbol: DGKA
  Gene Name: diacylglycerol kinase, alpha 80kDa
  Uniprot ID: P23743
  ENSP ID: ENSP00000377703

SEQ ID NO: 24148 - protein, 247 aa, Homo sapiens
  Payload ID: 4826
  Gene Symbol: DGKA
  Gene Name: diacylglycerol kinase, alpha 80kDa
  Uniprot ID: P23743
  ENSP ID: ENSP00000385792
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNRPITCVGARRL

SEQ ID NO: 24149 - protein, 116 aa, Homo sapiens
  Payload ID: 4826
  Gene Symbol: DGKA
  Gene Name: diacylglycerol kinase, alpha 80kDa
  ENSP ID: ENSP00000402307
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLE

SEQ ID NO: 24150 - protein, 58 aa, Homo sapiens
  Payload ID: 4826
  Gene Symbol: DGKA
  Gene Name: diacylglycerol kinase, alpha 80kDa
  ENSP ID: ENSP00000446515
MAKERGLISPSDFAQLQKYMEYSTKKVSDVLKLFEDGEMAKYVQGDAIGYEGFQQFLK

SEQ ID NO: 24151 - protein, 118 aa, Homo sapiens
  Payload ID: 4826
  Gene Symbol: DGKA
  Gene Name: diacylglycerol kinase, alpha 80kDa
  Uniprot ID: P23743
  ENSP ID: ENSP00000446605
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEWS

SEQ ID NO: 24152 - protein, 147 aa, Homo sapiens
  Payload ID: 4826
  Gene Symbol: DGKA
  Gene Name: diacylglycerol kinase, alpha 80kDa
  ENSP ID: ENSP00000447050
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAE

SEQ ID NO: 24153 - protein, 133 aa, Homo sapiens
  Payload ID: 4826
  Gene Symbol: DGKA
  Gene Name: diacylglycerol kinase, alpha 80kDa
  ENSP ID: ENSP00000447460
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSS

SEQ ID NO: 24154 - protein, 118 aa, Homo sapiens; identical to SEQ ID NO: 24151
  Payload ID: 4826
  Gene Symbol: DGKA
  Gene Name: diacylglycerol kinase, alpha 80kDa
  Uniprot ID: P23743
  ENSP ID: ENSP00000448565

SEQ ID NO: 24155 - protein, 21 aa, Homo sapiens
  Payload ID: 4826
  Gene Symbol: DGKA
  Gene Name: diacylglycerol kinase, alpha 80kDa
  ENSP ID: ENSP00000449178
MAKERGLISPSDFAQLQKYME

SEQ ID NO: 24156 - protein, 116 aa, Homo sapiens; identical to SEQ ID NO: 24149
  Payload ID: 4826
  Gene Symbol: DGKA
  Gene Name: diacylglycerol kinase, alpha 80kDa
  ENSP ID: ENSP00000449923

SEQ ID NO: 24157 - protein, 735 aa, Homo sapiens; identical to SEQ ID NO: 24146
  Payload ID: 4826
  Gene Symbol: DGKA
  Gene Name: diacylglycerol kinase, alpha 80kDa
  Uniprot ID: P23743
  ENSP ID: ENSP00000450359

SEQ ID NO: 24158 - protein, 44 aa, Homo sapiens
  Payload ID: 4826
  Gene Symbol: DGKA
  Gene Name: diacylglycerol kinase, alpha 80kDa
  ENSP ID: ENSP00000450608
MAKERGLISPSDFAQLQKYMEYSTKKVSDVLKLFEDGEMAKYVQ

SEQ ID NO: 24159 - protein, 94 aa, Homo sapiens
  Payload ID: 4826
  Gene Symbol: DGKA
  Gene Name: diacylglycerol kinase, alpha 80kDa
  ENSP ID: ENSP00000450977
MAKERGLISPSDFAQLQKYMESSSVALSSVLLRCAHDWKWEEWEMGRCQKKIRIYHSLTGLHCARSRLSTHLRYTWTACSSSQRRGVKSDSTKK

SEQ ID NO: 24160 - protein, 107 aa, Homo sapiens
  Payload ID: 4826
  Gene Symbol: DGKA
  Gene Name: diacylglycerol kinase, alpha 80kDa
  ENSP ID: ENSP00000450999
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLE

SEQ ID NO: 24161 - protein, 133 aa, Homo sapiens; identical to SEQ ID NO: 24153
  Payload ID: 4826
  Gene Symbol: DGKA
  Gene Name: diacylglycerol kinase, alpha 80kDa
  ENSP ID: ENSP00000451266

SEQ ID NO: 24162 - protein, 97 aa, Homo sapiens
  Payload ID: 4826
  Gene Symbol: DGKA
  Gene Name: diacylglycerol kinase, alpha 80kDa
  ENSP ID: ENSP00000451330
CNLCESSIGLGKQGLSCNLCKYTVHDQCAMKALPCEVSTYAKSRKDIGPLPPLGPAQTLPDKELPFSPRSNHMCGCEEAVSPGAATAVRKRSGSTTV

SEQ ID NO: 24163 - protein, 202 aa, Homo sapiens
  Payload ID: 4826
  Gene Symbol: DGKA
  Gene Name: diacylglycerol kinase, alpha 80kDa
  ENSP ID: ENSP00000451518
LRIDPVPNTHPLLVFVNPKSGGKQGQRLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNL

SEQ ID NO: 24164 - protein, 545 aa, Homo sapiens
  Payload ID: 4826
  Gene Symbol: DGKA
  Gene Name: diacylglycerol kinase, alpha 80kDa
  ENSP ID: ENSP00000451743
MAKERGLISPSDFAQLQKYMEYSTKKGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGIN

SEQ ID NO: 24165 - protein, 44 aa, Homo sapiens; identical to SEQ ID NO: 24158
  Payload ID: 4826
  Gene Symbol: DGKA
  Gene Name: diacylglycerol kinase, alpha 80kDa
  ENSP ID: ENSP00000451814

SEQ ID NO: 24166 - protein, 44 aa, Homo sapiens; identical to SEQ ID NO: 24158
  Payload ID: 4826
  Gene Symbol: DGKA
  Gene Name: diacylglycerol kinase, alpha 80kDa
  ENSP ID: ENSP00000452353

SEQ ID NO: 24167 - protein, 804 aa, Homo sapiens [sequence omitted]

SEQ ID NO: 24168 - protein, 803 aa, Homo sapiens
  Payload ID: 4827
  Gene Symbol: DGKB
  Gene Name: diacylglycerol kinase, beta 90kDa
  ENSP ID: ENSP00000384909
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 24169 - protein, 796 aa, Homo sapiens
  Payload ID: 4827
  Gene Symbol: DGKB
  Gene Name: diacylglycerol kinase, beta 90kDa
  ENSP ID: ENSP00000385031
MTNQEKWAHLSPSEFSQLQKYAEYSTKKLKDVLEEFHGNGVLAKYNPEGTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 24170 - protein, 804 aa, Homo sapiens [sequence omitted]

SEQ ID NO: 24171 - protein, 773 aa, Homo sapiens
  Payload ID: 4827
  Gene Symbol: DGKB
  Gene Name: diacylglycerol kinase, beta 90kDa
  Uniprot ID: Q9Y6T7
  ENSP ID: ENSP00000386066
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTVSTE

SEQ ID NO: 24172 - protein, 75 aa, Homo sapiens
  Payload ID: 4827
  Gene Symbol: DGKB
  Gene Name: diacylglycerol kinase, beta 90kDa
  ENSP ID: ENSP00000405569
MTNQEKWAHLSPSEFSQLQKYAEYSTKKLKDVLEEFHGNGVLAKYNPEGKQDILNQTIDFEGFKLFMKTFLEAEL

SEQ ID NO: 24173 - protein, 1214 aa, Homo sapiens
  Payload ID: 4828
  Gene Symbol: DGKD
  Gene Name: diacylglycerol kinase, delta 130kDa
  Uniprot ID: Q16760
  ENSP ID: ENSP00000264057
MAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 24174 - protein, 1170 aa, Homo sapiens
  Payload ID: 4828
  Gene Symbol: DGKD
  Gene Name: diacylglycerol kinase, delta 130kDa
  Uniprot ID: Q16760
  ENSP ID: ENSP00000386455
MNMFLYFQTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 24175 - protein, 451 aa, Homo sapiens
  Payload ID: 4828
  Gene Symbol: DGKD
  Gene Name: diacylglycerol kinase, delta 130kDa
  ENSP ID: ENSP00000390970
  MOD_RES (1)..(1): Any amino acid
XRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLERSQTQSPRPHDPIPVNCLEEAPPWRWKVDERRQG

SEQ ID NO: 24176 - protein, 164 aa, Homo sapiens
  Payload ID: 4828
  Gene Symbol: DGKD
  Gene Name: diacylglycerol kinase, delta 130kDa
  ENSP ID: ENSP00000395530
SPRSQTLIRPQKDCACACVCVCTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSC

SEQ ID NO: 24177 - protein, 157 aa, Homo sapiens
  Payload ID: 4828
  Gene Symbol: DGKD
  Gene Name: diacylglycerol kinase, delta 130kDa
  ENSP ID: ENSP00000407938
MAAAAGAPPPGPPQPPPPPPPEESSDSEPEAEPGSPQKLIRKVSTSGQIRQKVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASI

SEQ ID NO: 24178 - protein, 1168 aa, Homo sapiens
  Payload ID: 4828
  Gene Symbol: DGKD
  Gene Name: diacylglycerol kinase, delta 130kDa
  ENSP ID: ENSP00000479051
MNMFLYFQTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGDPSPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 24179 - protein, 163 aa, Homo sapiens
  Payload ID: 4828
  Gene Symbol: DGKD
  Gene Name: diacylglycerol kinase, delta 130kDa
  ENSP ID: ENSP00000485047
  MOD_RES (1)..(1): Any amino acid
XPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTAEVRWCDLGSLQPPSPRFKGSSCLSLPSSWDYSRAPLCPDNLRNFSRDGVSPYWPGWSQTPGLE

SEQ ID NO: 24180 - protein, 451 aa, Homo sapiens; identical to SEQ ID NO: 24175
  Payload ID: 4828
  Gene Symbol: DGKD
  Gene Name: diacylglycerol kinase, delta 130kDa
  ENSP ID: ENSP00000486226
  MOD_RES (1)..(1): Any amino acid

SEQ ID NO: 24181 - protein, 1168 aa, Homo sapiens; identical to SEQ ID NO: 24178
  Payload ID: 4828
  Gene Symbol: DGKD
  Gene Name: diacylglycerol kinase, delta 130kDa
  ENSP ID: ENSP00000486362

SEQ ID NO: 24182 - protein, 163 aa, Homo sapiens; identical to SEQ ID NO: 24179
  Payload ID: 4828
  Gene Symbol: DGKD
  Gene Name: diacylglycerol kinase, delta 130kDa
  ENSP ID: ENSP00000486850
  MOD_RES (1)..(1): Any amino acid

SEQ ID NO: 24183 - protein, 164 aa, Homo sapiens; identical to SEQ ID NO: 24176
  Payload ID: 4828
  Gene Symbol: DGKD
  Gene Name: diacylglycerol kinase, delta 130kDa
  ENSP ID: ENSP00000487210

SEQ ID NO: 24184 - protein, 1214 aa, Homo sapiens; identical to SEQ ID NO: 24173
  Payload ID: 4828
  Gene Symbol: DGKD
  Gene Name: diacylglycerol kinase, delta 130kDa
  Uniprot ID: Q16760
  ENSP ID: ENSP00000487220

SEQ ID NO: 24185 - protein, 1170 aa, Homo sapiens; identical to SEQ ID NO: 24174
  Payload ID: 4828
  Gene Symbol: DGKD
  Gene Name: diacylglycerol kinase, delta 130kDa
  Uniprot ID: Q16760
  ENSP ID: ENSP00000487423

SEQ ID NO: 24186 - protein, 157 aa, Homo sapiens; identical to SEQ ID NO: 24177
  Payload ID: 4828
  Gene Symbol: DGKD
  Gene Name: diacylglycerol kinase, delta 130kDa
  ENSP ID: ENSP00000487483

SEQ ID NO: 24187 - protein, 567 aa, Homo sapiens
  Payload ID: 4829
  Gene Symbol: DGKE
  Gene Name: diacylglycerol kinase, epsilon 64kDa
  Uniprot ID: P52429
  ENSP ID: ENSP00000284061
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRLILKCSMMPMQVDGEPWAQGPCTVTITHKTHAMMLYFSGEQTDDDISSTSDQEDIKATE

SEQ ID NO: 24188 - protein, 456 aa, Homo sapiens
  Payload ID: 4829
  Gene Symbol: DGKE
  Gene Name: diacylglycerol kinase, epsilon 64kDa
  ENSP ID: ENSP00000458493
  MOD_RES (1)..(1): Any amino acid
XSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRVGEI

SEQ ID NO: 24189 - protein, 177 aa, Homo sapiens
  Payload ID: 4829
  Gene Symbol: DGKE
  Gene Name: diacylglycerol kinase, epsilon 64kDa
  Uniprot ID: P52429
  ENSP ID: ENSP00000459295
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRYGLRGHSLSQNAPWESGFHRVV

SEQ ID NO: 24190 - protein, 70 aa, Homo sapiens
  Payload ID: 4829
  Gene Symbol: DGKE
  Gene Name: diacylglycerol kinase, epsilon 64kDa
  ENSP ID: ENSP00000459958
HCAQIQVKLANPFRIGQAHTVRVDGEPWAQGPCTVTITHKTHAMMLYFSGEQTDDDISSTSDQEDIKATE

SEQ ID NO: 24191 - protein, 1164 aa, Homo sapiens
  Payload ID: 4830
  Gene Symbol: DGKH
  Gene Name: diacylglycerol kinase, eta
  Uniprot ID: Q86XP1
  ENSP ID: ENSP00000261491
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 24192 - protein, 1220 aa, Homo sapiens
  Payload ID: 4830
  Gene Symbol: DGKH
  Gene Name: diacylglycerol kinase, eta
  Uniprot ID: Q86XP1
  ENSP ID: ENSP00000337572
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 24193 - protein, 1164 aa, Homo sapiens; identical to SEQ ID NO: 24191
  Payload ID: 4830
  Gene Symbol: DGKH
  Gene Name: diacylglycerol kinase, eta
  Uniprot ID: Q86XP1
  ENSP ID: ENSP00000368576

SEQ ID NO: 24194 - protein, 1100 aa, Homo sapiens
  Payload ID: 4830
  Gene Symbol: DGKH
  Gene Name: diacylglycerol kinase, eta
  Uniprot ID: Q86XP1
  ENSP ID: ENSP00000445114
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKNTVGEKRDTKENGKHMDLGIPKVGHVKRILQGIKELGRSTPQSEV

SEQ ID NO: 24195 - protein, 62 aa, Homo sapiens
  Payload ID: 4830
  Gene Symbol: DGKH
  Gene Name: diacylglycerol kinase, eta
  ENSP ID: ENSP00000482250
AAAGAGAAVTSAAASAGPGEDSSDSEAEQEGPQKLIRKVSTSGQIRTKGFIMLARLVTSELK

SEQ ID NO: 24196 - protein, 1084 aa, Homo sapiens
  Payload ID: 4830
  Gene Symbol: DGKH
  Gene Name: diacylglycerol kinase, eta
  Uniprot ID: Q86XP1
  ENSP ID: ENSP00000485809
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 24197 - protein, 89 aa, Homo sapiens
  Payload ID: 4830
  Gene Symbol: DGKH
  Gene Name: diacylglycerol kinase, eta
  ENSP ID: ENSP00000486329
MLCAENRKEMEDWISSLKSVQTREPYEVAQFNVEHFSGMHNWYACSHARPTFCNVCRESLSGVTSHGLSCEGTHCLQRFIPSNMSTWSM

SEQ ID NO: 24198 - protein, 1028 aa, Homo sapiens
  Payload ID: 4830
  Gene Symbol: DGKH
  Gene Name: diacylglycerol kinase, eta
  ENSP ID: ENSP00000486838
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPALPLHSVLHLLWPTFAL

SEQ ID NO: 24199 - protein, 791 aa, Homo sapiens
  Payload ID: 4831
  Gene Symbol: DGKG
  Gene Name: diacylglycerol kinase, gamma 90kDa
  Uniprot ID: P49619
  ENSP ID: ENSP00000265022
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 24200 - protein, 766 aa, Homo sapiens
  Payload ID: 4831
  Gene Symbol: DGKG
  Gene Name: diacylglycerol kinase, gamma 90kDa
  Uniprot ID: P49619
  ENSP ID: ENSP00000339777
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 24201 - protein, 752 aa, Homo sapiens
  Payload ID: 4831
  Gene Symbol: DGKG
  Gene Name: diacylglycerol kinase, gamma 90kDa
  Uniprot ID: P49619
  ENSP ID: ENSP00000371599
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGRHAWTMKHFKKPTYCNFCHIMLMGVRKQGLCCTYCKYTVHERCVSRNIPGCVKTYSKAKRSGEFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 24202 - protein, 154 aa, Homo sapiens
  Payload ID: 4831
  Gene Symbol: DGKG
  Gene Name: diacylglycerol kinase, gamma 90kDa
  ENSP ID: ENSP00000395526
HIAQYLEWDPTELRPGSKGDGRHAWTMKHFKKPTYCNFCHIMLMGVRKQGLCCTYCKYTVHERCVSRNIPGCVKTYSKAKRSGEVMQHAWVEGNSSVKCDRCHKSIKCYQSVTARHCVWCRMTFHRKCELSTLCDGGELRDHILLPTSICPITR

SEQ ID NO: 24203 - protein, 1065 aa, Homo sapiens
  Payload ID: 4832
  Gene Symbol: DGKI
  Gene Name: diacylglycerol kinase, iota
  Uniprot ID: O75912
  ENSP ID: ENSP00000288490
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24204 - protein, 734 aa, Homo sapiens
  Payload ID: 4832
  Gene Symbol: DGKI
  Gene Name: diacylglycerol kinase, iota
  ENSP ID: ENSP00000392161
MLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDATSADRFYRIDRSQEHLHFVMEISQDEIFILDPDMVVSQPAGTPPGMPDLVVEQASGSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24205 - protein, 1078 aa, Homo sapiens
  Payload ID: 4832
  Gene Symbol: DGKI
  Gene Name: diacylglycerol kinase, iota
  ENSP ID: ENSP00000396078
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDIHQVQTADLRRVSAPPGSFTIPQSVPDRLRIRVNKISLQDYEGFHYDKEKLREASIPLGILVVRGDCDLETCRMYIDRLQEDLQSVSSGSQRVHYQDHETSFPRALSAQRLSPRWCFLDATSADRFYRIDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24206 - protein, 1047 aa, Homo sapiens
  Payload ID: 4832
  Gene Symbol: DGKI
  Gene Name: diacylglycerol kinase, iota
  ENSP ID: ENSP00000399131
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24207 - protein, 932 aa, Homo sapiens
  Payload ID: 4832
  Gene Symbol: DGKI
  Gene Name: diacylglycerol kinase, iota
  ENSP ID: ENSP00000479053
RKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24208 - protein, 1271 aa, Homo sapiens
  Payload ID: 4833
  Gene Symbol: DGKK
  Gene Name: diacylglycerol kinase, kappa
  Uniprot ID: Q5KSL6
  ENSP ID: ENSP00000477515
MDRGAAAAQGTAPPQDGEQPAESPEPPPPWPPPPPPPAPPPAPPLLSEASPEPIPEPCPELAPGPCPEATSESATELYTEPTPEPATEPASEPAPEPATEPAPEPATEPAPEPAPEPATESAPEPTPEPALESVPEPAPELTPEVAPELAPEPTPEPVTELAPEFCPEAAPEFRPSPAPCLLQCPVDTRERGLKTSPSPSPSPSPRTPMSWSRIKKILKEGPMLKNCNSFKRWKLRYFLVQGQKLYFAHHPAFAHFETIDLSQATVAESSCRNLCHSFCVITPQRKITLAAPNRKDMEEWINIIKTIQQGEIYKIPAAENNPFLVGMHCWYSSYSHRTQHCNVCRESIPALSRDAIICEVCKVKSHRLCALRASKDCKWNTLSITDDLLLPADEVNMPHQWVEGNMPVSSQCAVCHESCGSYQRLQDFRCLWCNSTVHDDCRRRFSKECCFRSHRSSVIPPTALSDPKGDGQLVVSSDFWNLDWSSACSCPLLIFINSKSGDHQGIVFLRKFKQYLNPSQVFDLLKGGPEAGLSMFKNFARFRILVCGGDGSVSWVLSLIDAFGLHEKCQLAVIPLGTGNDLARVLGWGAFWNKSKSPLDILNRVEQASVRILDRWSVMIRETPRQTPLLKGQVEMDVPRFEAAAIQHLESAATELNKILKAKYPTEMIIATRFLCSAVEDFVVDIVKAWGQIKQNNTAIVSVILKSDLMYDRLSVLIDVLAEEAAATSAEKSATEYADSSKADRKPFIPQIDHIAKCKLELATKAQSLQKSLKLIIFQVEQALDEESRQTISVKNFSSTFFLEDDPEDINQTSPRRRSRRGTLSSISSLKSEDLDNLNLDHLHFTPESIRFKEKCVMNNYFGIGLDAKISLDFNTRRDEHPGQYNSRLKNKMWYGLLGTKELLQRSYRKLEERVHLECDGETISLPNLQGIVVLNITSYAGGINFWGSNTATTEYEAPAIDDGKLEVVAIFGSVQMAMSRIINLHHHRIAQCHEVMITIDGEEGIPVQVDGEAWIQRPGLIKIRYKNAAQMLTRDRDFENSMKMWEYKHTEIQAAPQPQLDFQDSQESLSDEEYAQMQHLARLAENLISKLNDLSKIHQHVSVLMGSVNASANILNDIFYGQDSGNEMGAASCIPIETLSRNDAVDVTFSLKGLYDDTTAFLDEKLLRSAEDETALQSALDAMNKEFKKLSEIDWMNPIFVPEEKSSDTDSRSLRLKIKFPKLGKKKVEEERKPKSGQSVQSFIGNLWHRRHREDEAEGDDPLTPSRSQL

SEQ ID NO: 24209 - protein, 942 aa, Homo sapiens
  Payload ID: 4834
  Gene Symbol: DGKQ
  Gene Name: diacylglycerol kinase, theta 110kDa
  Uniprot ID: P52824
  ENSP ID: ENSP00000273814
MAAAAEPGARAWLGGGSPRPGSPACSPVLGSGGRARPGPGPGPGPERAGVRAPGPAAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADAAPAPESDPR

SEQ ID NO: 24210 - protein, 157 aa, Homo sapiens
  Payload ID: 4834
  Gene Symbol: DGKQ
  Gene Name: diacylglycerol kinase, theta 110kDa
  ENSP ID: ENSP00000421756
PKIVQMSNYCGIGIDAELSLDFHQAREEEPGKFTSSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADAAPAPESDPR

SEQ ID NO: 24211 - protein, 876 aa, Homo sapiens
  Payload ID: 4834
  Gene Symbol: DGKQ
  Gene Name: diacylglycerol kinase, theta 110kDa
  ENSP ID: ENSP00000425862
  MOD_RES (1)..(1): Any amino acid
XPAAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADAAPAPESDPR

SEQ ID NO: 24212 - protein, 143 aa, Homo sapiens
  Payload ID: 4834
  Gene Symbol: DGKQ
  Gene Name: diacylglycerol kinase, theta 110kDa
  ENSP ID: ENSP00000427268
MTRKALRRTLRPLVLFCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWC

SEQ ID NO: 24213 - protein, 906 aa, Homo sapiens
  Payload ID: 4835
  Gene Symbol: DGKZ
  Gene Name: diacylglycerol kinase, zeta
  Uniprot ID: Q13574
  ENSP ID: ENSP00000320340
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24214 - protein, 945 aa, Homo sapiens
  Payload ID: 4835
  Gene Symbol: DGKZ
  Gene Name: diacylglycerol kinase, zeta
  Uniprot ID: Q13574
  ENSP ID: ENSP00000343065
MAEGQGGGGQRWDWAGGGRAAEEEVVRRRCRRGEEAQVAQPWPEGSRGTAAGPPVEERFRQLHLRKQVSYRKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24215 - protein, 929 aa, Homo sapiens
  Payload ID: 4835
  Gene Symbol: DGKZ
  Gene Name: diacylglycerol kinase, zeta
  Uniprot ID: Q13574
  ENSP ID: ENSP00000391021
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24216 - protein, 928 aa, Homo sapiens
  Payload ID: 4835
  Gene Symbol: DGKZ
  Gene Name: diacylglycerol kinase, zeta
  Uniprot ID: Q13574
  ENSP ID: ENSP00000395684
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24217 - protein, 1117 aa, Homo sapiens
  Payload ID: 4835
  Gene Symbol: DGKZ
  Gene Name: diacylglycerol kinase, zeta
  Uniprot ID: Q13574
  ENSP ID: ENSP00000412178
METFFRRHFRGKVPGPGEGQQRPSSVGLPTGKARRRSPAGQASSSLAQRRRSSAQLQGCLLSCGVRAQGSSRRRSSTVPPSCNPRFIVDKVLTPQPTTVGAQLLGAPLLLTGLVGMNEEEGVQEDVVAEASSAIQPGTKTPGPPPPRGAQPLLPLPRYLRRASSHLLPADAVYDHALWGLHGYYRRLSQRRPSGQHPGPGGRRASGTTAGTMLPTRVRPLSRRRQVALRRKAAGPQAWSALLAKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24218 - protein, 197 aa, Homo sapiens
  Payload ID: 4835
  Gene Symbol: DGKZ
  Gene Name: diacylglycerol kinase, zeta
  ENSP ID: ENSP00000434016
  MOD_RES (1)..(1): Any amino acid
XRNKMFYAGTAFSDFLMGSSKDLAKHIRVVVSGARLPWVGGPEGREAEATWHMHLNTLPARLQCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVP

SEQ ID NO: 24219 - protein, 707 aa, Homo sapiens
  Payload ID: 4835
  Gene Symbol: DGKZ
  Gene Name: diacylglycerol kinase, zeta
  ENSP ID: ENSP00000434719
MLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24220 - protein, 16 aa, Homo sapiens
  Payload ID: 4835
  Gene Symbol: DGKZ
  Gene Name: diacylglycerol kinase, zeta
  ENSP ID: ENSP00000435332
MLQKSVSRRKCAACKI

SEQ ID NO: 24221 - protein, 54 aa, Homo sapiens
  Payload ID: 4835
  Gene Symbol: DGKZ
  Gene Name: diacylglycerol kinase, zeta
  ENSP ID: ENSP00000435435
MEPRDGSPEARSSDSESASASSSGSERDAGPEPDKAPRRLNKRRFPGLRLFGHR

SEQ ID NO: 24222 - protein, 98 aa, Homo sapiens
  Payload ID: 4835
  Gene Symbol: DGKZ
  Gene Name: diacylglycerol kinase, zeta
  ENSP ID: ENSP00000435763
ESATYGEHIWFETNVSGDFCYVGEQYCVARMLINFRCKPSFRESGSRNVREPTFVRHHWVHRRRQDGKCRHCGKGFQQKFTFHSKEIVAISCSWCKQA

SEQ ID NO: 24223 - protein, 933 aa, Homo sapiens
  Payload ID: 4835
  Gene Symbol: DGKZ
  Gene Name: diacylglycerol kinase, zeta
  Uniprot ID: Q13574
  ENSP ID: ENSP00000436273
MSAPGAGHSAGGSCNESSALGPVEALGTEEGERPGSLRQMWRYRSWDVPQIPSEAPQTQKAITKSGLQHLAPPPPTPGAPCSESERQIRSTVDWSSATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24224 - protein, 934 aa, Homo sapiens
  Payload ID: 4835
  Gene Symbol: DGKZ
  Gene Name: diacylglycerol kinase, zeta
  Uniprot ID: Q13574
  ENSP ID: ENSP00000436291
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENPCSPSGETCLHQAAALGQRTICHYIVEAGASLMKTDQQGDTPRQRAEKAQDTELAAYLENRQHYQMIQREDQETAV

SEQ ID NO: 24225 - protein, 135 aa, Homo sapiens
  Payload ID: 4835
  Gene Symbol: DGKZ
  Gene Name: diacylglycerol kinase, zeta
  ENSP ID: ENSP00000437060
MWRYRSWDVPQIPSEAPQTQKAITKSGLQHLAPPPPTPGAPCSESERQIRSTVDWSESATYGEHIWFETNVSGDFCYVGEQYCVARMLKSVSRRKCAACKIVVHTPCIEQLEKDSRDDLGVSPPCEDDSGLSWRE

SEQ ID NO: 24226 - protein, 1042 aa, Homo sapiens
  Payload ID: 4836
  Gene Symbol: DAGLA
  Gene Name: diacylglycerol lipase, alpha
  Uniprot ID: Q9Y4D2
  ENSP ID: ENSP00000257215
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMQYVLYVRLAILVIEFIYAIVGIVWLTQYYTSCNDLTAKNVTLGMVVCNWVVILSVCITVLCVFDPTGRTFVKLRATKRRQRNLRTYNLRHRLEEGQATSWSRRLKVFLCCTRTKDSQSDAYSEIAYLFAEFFRDLDIVPSDIIAGLVLLRQRQRAKRNAVLDEANNDILAFLSGMPVTRNTKYLDLKNSQEMLRYKEVCYYMLFALAAYGWPMYLMRKPACGLCQLARSCSCCLCPARPRFAPGVTIEEDNCCGCNAIAIRRHFLDENMTAVDIVYTSCHDAVYETPFYVAVDHDKKKVVISIRGTLSPKDALTDLTGDAERLPVEGHHGTWLGHKGMVLSAEYIKKKLEQEMVLSQAFGRDLGRGTKHYGLIVVGHSLGAGTAAILSFLLRPQYPTLKCFAYSPPGGLLSEDAMEYSKEFVTAVVLGKDLVPRIGLSQLEGFRRQLLDVLQRSTKPKWRIIVGATKCIPKSELPEEVEVTTLASTRLWTHPSDLTIALSASTPLYPPGRIIHVVHNHPAEQCCCCEQEEPTYFAIWGDNKAFNEVIISPAMLHEHLPYVVMEGLNKVLENYNKGKTALLSAAKVMVSPTEVDLTPELIFQQQPLPTGPPMPTGLALELPTADHRNSSVRSKSQSEMSLEGFSEGRLLSPVVAAAARQDPVELLLLSTQERLAAELQARRAPLATMESLSDTESLYSFDSRRSSGFRSIRGSPSLHAVLERDEGHLFYIDPAIPEENPSLSSRTELLAADSLSKHSQDTQPLEAALGSGGVTPERPPSAAANDEEEEVGGGGGGPASRGELALHNGRLGDSPSPQVLEFAEFIDSLFNLDSKSSSFQDLYCMVVPESPTSDYAEGPKSPSQQEILLRAQFEPNLVPKPPRLFAGSADPSSGISLSPSFPLSSSGELMDLTPTGLSSQECLAADKIRTSTPTGHGASPAKQDELVISAR

SEQ ID NO: 24227 - protein, 167 aa, Homo sapiens
  Payload ID: 4836
  Gene Symbol: DAGLA
  Gene Name: diacylglycerol lipase, alpha
  ENSP ID: ENSP00000440264
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMHHPGDRVHLRHRGHRLAHSVLHLLQRPHCQECHPRNGCLQLGSHPQCVHHCPLRLRPHGPHLCQAESHQEEAA

SEQ ID NO: 24228 - protein, 672 aa, Homo sapiens
  Payload ID: 4837
  Gene Symbol: DAGLB
  Gene Name: diacylglycerol lipase, beta
  Uniprot ID: Q8NCG7
  ENSP ID: ENSP00000297056
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 24229 - protein, 543 aa, Homo sapiens
  Payload ID: 4837
  Gene Symbol: DAGLB
  Gene Name: diacylglycerol lipase, beta
  Uniprot ID: Q8NCG7
  ENSP ID: ENSP00000391171
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVRTQIWCPATLRRASPCFISNRTISGTTKSLPRWSAMPQGAPSCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 24230 - protein, 631 aa, Homo sapiens
  Payload ID: 4837
  Gene Symbol: DAGLB
  Gene Name: diacylglycerol lipase, beta
  ENSP ID: ENSP00000404785
MHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 24231 - protein, 149 aa, Homo sapiens
  Payload ID: 4837
  Gene Symbol: DAGLB
  Gene Name: diacylglycerol lipase, beta
  ENSP ID: ENSP00000410787
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSCRSRTTDYD

SEQ ID NO: 24232 - protein, 172 aa, Homo sapiens
  Payload ID: 4837
  Gene Symbol: DAGLB
  Gene Name: diacylglycerol lipase, beta
  ENSP ID: ENSP00000411746
MPGMVLFGRRWAIASDDLVFPGFFELVVRVLWWIGILTLYLMHRGKLDCAGGALLSSYLIVLMILLAVVICTVSAIMCVSMRGHRSGAQRHCGGPRPASSATGQYQEQPRACPGGLPCPRELPAAEAEPQTMTWSEAISSTVTSAPSCTPQGCSTGTSSTSASMTRFTSCRF

SEQ ID NO: 24233 - protein, 315 aa, Homo sapiens
  Payload ID: 4838
  Gene Symbol: DGAT1
  Gene Name: diacylglycerol O-acyltransferase 1
  ENSP ID: ENSP00000332258
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAAHASTGQQQVDGQDRGVPGLGLLPRVPGERPSANVPPLGVHGHDGSDPTGLVRGPLFPGQLWQRSCVAVAHHRTANSRPHVRPRLLRAQL

SEQ ID NO: 24234 - protein, 488 aa, Homo sapiens
  Payload ID: 4838
  Gene Symbol: DGAT1
  Gene Name: diacylglycerol O-acyltransferase 1
  Uniprot ID: O75907
  ENSP ID: ENSP00000482264
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 24235 - protein, 388 aa, Homo sapiens
  Payload ID: 4839
  Gene Symbol: DGAT2
  Gene Name: diacylglycerol O-acyltransferase 2
  Uniprot ID: Q96PD7
  ENSP ID: ENSP00000228027
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 24236 - protein, 345 aa, Homo sapiens
  Payload ID: 4839
  Gene Symbol: DGAT2
  Gene Name: diacylglycerol O-acyltransferase 2
  Uniprot ID: Q96PD7
  ENSP ID: ENSP00000365438
MKTLIAAYSGVLRGERQAEADRSQRSHGGPALSREGSGRWGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 24237 - protein, 160 aa, Homo sapiens
  Payload ID: 4839
  Gene Symbol: DGAT2
  Gene Name: diacylglycerol O-acyltransferase 2
  ENSP ID: ENSP00000474015
MYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGK

SEQ ID NO: 24238 - protein, 295 aa, Homo sapiens
  Payload ID: 4839
  Gene Symbol: DGAT2
  Gene Name: diacylglycerol O-acyltransferase 2
  ENSP ID: ENSP00000474668
LIAAYSGVLRGERQAEADRSQRSHGGPALSREGSGRWGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEP

SEQ ID NO: 24239 - protein, 112 aa, Homo sapiens
  Payload ID: 4839
  Gene Symbol: DGAT2
  Gene Name: diacylglycerol O-acyltransferase 2
  ENSP ID: ENSP00000474887
MYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPV

SEQ ID NO: 24240 - protein, 113 aa, Homo sapiens
  Payload ID: 4839
  Gene Symbol: DGAT2
  Gene Name: diacylglycerol O-acyltransferase 2
  ENSP ID: ENSP00000475066
MYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVL

SEQ ID NO: 24241 - protein, 337 aa, Homo sapiens
  Payload ID: 4840
  Gene Symbol: DGAT2L6
  Gene Name: diacylglycerol O-acyltransferase 2-like 6
  Uniprot ID: Q6ZPD8
  ENSP ID: ENSP00000328036
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNQETFPEGTWLRLFQKTFQDTFKKILGLNFCTFHGRGFTRGSWGFLPFNRPITTVVGEPLPIPRIKRPNQKTVDKYHALYISALRKLFDQHKVEYGLPETQELTIT

SEQ ID NO: 24242 - protein, 1228 aa, Homo sapiens [sequence omitted]

SEQ ID NO: 24243 - protein, 1272 aa, Homo sapiens
  Payload ID: 4841
  Gene Symbol: DIAPH1
  Gene Name: diaphanous-related formin 1
  Uniprot ID: O60610
  ENSP ID: ENSP00000373706
MEPPGGSLGPGRGTRDKKKGRSPDELPSAGGDGGKSKKFTLKRLMADELERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 24244 - protein, 1263 aa, Homo sapiens [sequence omitted]

SEQ ID NO: 24245 - protein, 1272 aa, Homo sapiens [sequence omitted]

SEQ ID NO: 24246 - protein, 96 aa, Homo sapiens
  Payload ID: 4841
  Gene Symbol: DIAPH1
  Gene Name: diaphanous-related formin 1
  ENSP ID: ENSP00000408159
  MOD_RES (1)..(1): Any amino acid
XRETEEKMRRAKLAKEKAEKERLEKQQKREQLIDMNAEGDETGVMDSLLEALQSGAAFRRKRGPRQDNLLCPWEVEEEEETFKLPTGRPGVQSHLC

SEQ ID NO: 24247 - protein, 201 aa, Homo sapiens
  Payload ID: 4841
  Gene Symbol: DIAPH1
  Gene Name: diaphanous-related formin 1
  ENSP ID: ENSP00000428208
MEPPGGSLGPGRGTRDKKKGRSPDELPSAGGDGGKSKKFTLKRLMADELERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDD

SEQ ID NO: 24248 - protein, 1263 aa, Homo sapiens
  Payload ID: 4841
  Gene Symbol: DIAPH1
  Gene Name: diaphanous-related formin 1
  Uniprot ID: O60610
  ENSP ID: ENSP00000428268
MEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 24249 - protein, 112 aa, Homo sapiens
  Payload ID: 4841
  Gene Symbol: DIAPH1
  Gene Name: diaphanous-related formin 1
  ENSP ID: ENSP00000430587
MRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLE

SEQ ID NO: 24250 - protein, 1101 aa, Homo sapiens
  Payload ID: 4842
  Gene Symbol: DIAPH2
  Gene Name: diaphanous-related formin 2
  Uniprot ID: O60879
  ENSP ID: ENSP00000321348
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTSFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPDNRRVPLERSRSRHNGAISSK

SEQ ID NO: 24251 - protein, 1096 aa, Homo sapiens [sequence omitted]

SEQ ID NO: 24252 - protein, 1096 aa, Homo sapiens
  Payload ID: 4842
  Gene Symbol: DIAPH2
  Gene Name: diaphanous-related formin 2
  Uniprot ID: O60879
  ENSP ID: ENSP00000362140
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDERSLLLLARAIDPKQPNMMTEIVKILSAICIVGEENILDKLLGAITTAAERNNRERFSPIVEGLENQEALQLQVACMQFINALVTSPYELDFRIHLRNEFLRSGLKTMLPDLKEKENDELDIQLKVFDENKEDDLTELSHRLNDIRAEMDDMNEVYHLLYNMLKDTAAENYFLSILQHFLLIRNDYYIRPQYYKIIEECVSQIVLHCSGMDPDFKYRQRLDIDLTHLIDSCVNKAKVEESEQKAAEFSKKFDEEFTARQEAQAELQKRDEKIKELEAEIQQLRTQAQVLSSSSGIPGPPAAPPLPGVGPPPPPPAPPLPGGAPLPPPPPPLPGMMGIPPPPPPPLLFGGPPPPPPLGGVPPPPGISLNLPYGMKQKKMYKPEVSMKRINWSKIEPTELSENCFWLRVKEDKFENPDLFAKLALNFATQIKVQKNAEALEEKKTGPTKKKVKELRILDPKTAQNLSIFLGSYRMPYEDIRNVILEVNEDMLSEALIQNLVKHLPEQKILNELAELKNEYDDLCEPEQFGVVMSSVKMLQPRLSSILFKLTFEEHINNIKPSIIAVTLACEELKKSESFNRLLELVLLVGNYMNSGSRNAQSLGFKINFLCKIRDTKSADQKTTLLHFIADICEEKYRDILKFPEELEHVESASKVSAQILKSNLASMEQQIVHLERDIKKFPQAENQHDKFVEKMTSFTKTAREQYEKLSTMHNNMMKLYENLGEYFIFDSKTVSIEEFFGDLNNFRTLFLEAVRENNKRREMEEKTRRAKLAKEKAEQEKLERQKKKKQLIDINKEGDETGVMDNLLEALQSGAAFRDRRKRIPRNPVVNHPCATRANPRSAT

SEQ ID NO: 24253 - protein, 1103 aa, Homo sapiens [sequence omitted]

SEQ ID NO: 24254 - protein, 1101 aa, Homo sapiens [sequence omitted]

SEQ ID NO: 24255 - protein, 1112 aa, Homo sapiens
  Payload ID: 4843
  Gene Symbol: DIAPH3
  Gene Name: diaphanous-related formin 3
  Uniprot ID: Q9NSV4
  ENSP ID: ENSP00000267215
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 24256 - protein, 1182 aa, Homo sapiens
  Payload ID: 4843
  Gene Symbol: DIAPH3
  Gene Name: diaphanous-related formin 3
  Uniprot ID: Q9NSV4
  ENSP ID: ENSP00000367141
MERHQPRLHHPAQGSAAGTPYPSSASLRGCRESKMPRRKGPQHPPPPSGPEEPGEKRPKFLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 24257 - protein, 1123 aa, Homo sapiens
  Payload ID: 4843
  Gene Symbol: DIAPH3
  Gene Name: diaphanous-related formin 3
  Uniprot ID: Q9NSV4
  ENSP ID: ENSP00000383173
MERHQPRLHHPAQGSAAGTPYPSSASLRGCRESKMPRRKGPQHPPPPSGPEEPGEKRPKFEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 24258 - protein, 1147 aa, Homo sapiens
  Payload ID: 4843
  Gene Symbol: DIAPH3
  Gene Name: diaphanous-related formin 3
  Uniprot ID: Q9NSV4
  ENSP ID: ENSP00000383174
MERHQPRLHHPAQGSAAGTPYPSSASLRGCRESKMPRRKGPQHPPPPSGPEEPGEKRPKFLDKFASIRIPGSKKERPPLPNLKTAFASSDCSAAPLEMMENFPKPLSENELLELFEKMMGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 24259 - protein, 1193 aa, Homo sapiens
  Payload ID: 4843
  Gene Symbol: DIAPH3
  Gene Name: diaphanous-related formin 3
  Uniprot ID: Q9NSV4
  ENSP ID: ENSP00000383178
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFEKMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHENQKVQLTEGSRSHYNINCNSTRTPVAKELNYNLDTHTSTGRIKAAEKKEACNVESNRKKETELLGSFSKNESVPEVEALLARLRAL

SEQ ID NO: 24260 - protein, 849 aa, Homo sapiens
  Payload ID: 4843
  Gene Symbol: DIAPH3
  Gene Name: diaphanous-related formin 3
  Uniprot ID: Q9NSV4
  ENSP ID: ENSP00000478137
MSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKVSVETLEKNLRQMGRQLQQLEKELETFPPPEDLHDKFVTKMSRFVISAKEQYETLSKLHENMEKLYQSIIGYYAIDVKKVSVEDFLTDLNNFRTTFMQAIKENIKKREAEEKEKRVRIAKELAERERLERQQKKKRLLEMKTEGDETGVMDNLLEALQSGAAFRDRRKRTPMPKDVRQSLSPMSQRPVLKVCNHGNKPYL

SEQ ID NO: 24261 - protein, 691 aa, Homo sapiens
  Payload ID: 4843
  Gene Symbol: DIAPH3
  Gene Name: diaphanous-related formin 3
  Uniprot ID: Q9NSV4
  ENSP ID: ENSP00000479091
MSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVPPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDIEEKKSIKKKIKELKFLDSKIAQNLSIFLSSFRVPYEEIRMMILEVDETRLAESMIQNLIKHLPDQEQLNSLSQFKSEYSNLCEPEQFVVVMSNVKRLRPRLSAILFKLQFEEQVNNIKPDIMAVSTACEEIKKSKSFSKLLELVLLMGNYMNAGSRNAQTFGFNLSSLCKLKDTKSADQKTTLLHFLVEICEEKYPDILNFVDDLEPLDKASKGLCLFKKHFMALIFSAKRLKIIPFICMYFPLSHSVFIPNISF

SEQ ID NO: 24262 - protein, 104 aa, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000311117
MWGDLWLLPPASANPGTGTEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24263 - protein, 87 aa, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000348116
MSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24264 - protein, 88 aa, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000376815
MPAFAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24265 - protein, 104 aa, Homo sapiens; identical to SEQ ID NO: 24262
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000386486

SEQ ID NO: 24266 - protein, 104 aa, Homo sapiens; identical to SEQ ID NO: 24262
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000439012

SEQ ID NO: 24267 - protein, 143 aa, Homo sapiens
  Payload ID: 4844
  Gene Symbol: DBI
  Gene Name: diazepam binding inhibitor (GABA receptor modulator, acyl-CoA binding protein)
  ENSP ID: ENSP00000440698
MGWTSLCSGRGVGVEGAWRDGGRGCTDWRSEETQSPSRSTGQDVAAEWGSEESVAESLEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24268 - protein, 97 aa, Homo sapiens
  Payload ID: 4844
  Gene Symbol: DBI
  Gene Name: diazepam binding inhibitor (GABA receptor modulator, acyl-CoA binding protein)
  ENSP ID: ENSP00000442917
MSQVQRVHSQAAKAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24269 - protein, 129 aa, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000486281
MSQHRAGRRGGVGKRGVRGRELGGQGKYGAGCSECGTRRIAARGEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24270 - protein, 148 aa, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENSP ID: ENSP00000486361
MERWGKGLHGLEERGDSVPIPKHRAGRRGGVGKRGVRGRELGGQGKYGAGCSECGTRRIAARGEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 24271 - protein, 244 aa, Homo sapiens
  Payload ID: 4845
  Gene Symbol: DCXR
  Gene Name: dicarbonyl/L-xylulose reductase
  Uniprot ID: Q7Z4W1
  ENSP ID: ENSP00000303356
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 24272 - protein, 141 aa, Homo sapiens
  Payload ID: 4845
  Gene Symbol: DCXR
  Gene Name: dicarbonyl/L-xylulose reductase
  ENSP ID: ENSP00000462226
MELFLAGRRVLVTGAGKGGRRGKCPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELG

SEQ ID NO: 24273 - protein, 223 aa, Homo sapiens
  Payload ID: 4845
  Gene Symbol: DCXR
  Gene Name: dicarbonyl/L-xylulose reductase
  ENSP ID: ENSP00000462272
MELFLAGRRVLVTGAGKGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSD

SEQ ID NO: 24274 - protein, 143 aa, Homo sapiens
  Payload ID: 4845
  Gene Symbol: DCXR
  Gene Name: dicarbonyl/L-xylulose reductase
  ENSP ID: ENSP00000462725
  MOD_RES (1)..(1): Any amino acid
XSCSSRAAGCWSPGQAKCPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNA

SEQ ID NO: 24275 - protein, 176 aa, Homo sapiens
  Payload ID: 4845
  Gene Symbol: DCXR
  Gene Name: dicarbonyl/L-xylulose reductase
  ENSP ID: ENSP00000463354
VCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAGPTDVHNRGAEKTVVYAEISRK

SEQ ID NO: 24276 - protein, 86 aa, Homo sapiens
  Payload ID: 4845
  Gene Symbol: DCXR
  Gene Name: dicarbonyl/L-xylulose reductase
  ENSP ID: ENSP00000464332
  MOD_RES (1)..(1): Any amino acid
XMALELGPHKIRVNAVNPTVVMTSMGQATWSDPHKAKTMLNRIPLGKFAGESEVEHVVNAILFLLSDRSGMTTGSTLPVEGGFWAC

SEQ ID NO: 24277 - protein, 225 aa, Homo sapiens
  Payload ID: 4845
  Gene Symbol: DCXR
  Gene Name: dicarbonyl/L-xylulose reductase
  ENSP ID: ENSP00000464507
  MOD_RES (1)..(1): Any amino acid
XLFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAGESGGSPASVVPAVPR

SEQ ID NO: 24278 - protein, 100 aa, Homo sapiens
  Payload ID: 4845
  Gene Symbol: DCXR
  Gene Name: dicarbonyl/L-xylulose reductase
  ENSP ID: ENSP00000464518
  MOD_RES (1)..(1): Any amino acid
XLVNNAAVALLQPFLEVTKEAFDRSFEVNLRAVIQVSQIVARGLIARGVPGAIVNVSSQCSQRAVTNHSVYCSTKGALDMLTKVMALELGPHKLSRCRSE

SEQ ID NO: 24279 - protein, 1922 aa, Homo sapiens
  Payload ID: 4846
  Gene Symbol: DICER1
  Gene Name: dicer 1, ribonuclease type III
  Uniprot ID: Q9UPY3
  ENSP ID: ENSP00000343745
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 24280 - protein, 1922 aa, Homo sapiens; identical to SEQ ID NO: 24279
  Payload ID: 4846
  Gene Symbol: DICER1
  Gene Name: dicer 1, ribonuclease type III
  Uniprot ID: Q9UPY3
  ENSP ID: ENSP00000376783

SEQ ID NO: 24281 - protein, 70 aa, Homo sapiens
  Payload ID: 4846
  Gene Symbol: DICER1
  Gene Name: dicer 1, ribonuclease type III
  ENSP ID: ENSP00000433060
MKSPALQPLSMAGLQLMTPASSPMGPFFGLPWQQEAIHDNIYTPRKYQVELLEAALDHNTIVCLNTGSGK

SEQ ID NO: 24282 - protein, 70 aa, Homo sapiens; identical to SEQ ID NO: 24281
  Payload ID: 4846
  Gene Symbol: DICER1
  Gene Name: dicer 1, ribonuclease type III
  ENSP ID: ENSP00000433926

SEQ ID NO: 24283 - protein, 1922 aa, Homo sapiens; identical to SEQ ID NO: 24279
  Payload ID: 4846
  Gene Symbol: DICER1
  Gene Name: dicer 1, ribonuclease type III
  Uniprot ID: Q9UPY3
  ENSP ID: ENSP00000435681

SEQ ID NO: 24284 - protein, 1922 aa, Homo sapiens; identical to SEQ ID NO: 24279
  Payload ID: 4846
  Gene Symbol: DICER1
  Gene Name: dicer 1, ribonuclease type III
  Uniprot ID: Q9UPY3
  ENSP ID: ENSP00000437256

SEQ ID NO: 24285 - protein, 1829 aa, Homo sapiens
  Payload ID: 4846
  Gene Symbol: DICER1
  Gene Name: dicer 1, ribonuclease type III
  Uniprot ID: Q9UPY3
  ENSP ID: ENSP00000444719
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERQQFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSEKSFLQMYPVPLCENCLKWNQKLPNLARLRELTTGRSESLWK

SEQ ID NO: 24286 - protein, 820 aa, Homo sapiens
  Payload ID: 4846
  Gene Symbol: DICER1
  Gene Name: dicer 1, ribonuclease type III
  Uniprot ID: Q9UPY3
  ENSP ID: ENSP00000451041
MLAWESDHFLRILAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 24287 - protein, 394 aa, Homo sapiens
  Payload ID: 4846
  Gene Symbol: DICER1
  Gene Name: dicer 1, ribonuclease type III
  ENSP ID: ENSP00000452556
  MOD_RES (1)..(1): Any amino acid
XLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITGKEPTTRLHFWENETLC

SEQ ID NO: 24288 - protein, 266 aa, Homo sapiens
  Payload ID: 4847
  Gene Symbol: DKK1
  Gene Name: dickkopf WNT signaling pathway inhibitor 1
  Uniprot ID: O94907
  ENSP ID: ENSP00000363081
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 24289 - protein, 259 aa, Homo sapiens
  Payload ID: 4848
  Gene Symbol: DKK2
  Gene Name: dickkopf WNT signaling pathway inhibitor 2
  Uniprot ID: Q9UBU2
  ENSP ID: ENSP00000285311
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 24290 - protein, 159 aa, Homo sapiens
  Payload ID: 4848
  Gene Symbol: DKK2
  Gene Name: dickkopf WNT signaling pathway inhibitor 2
  ENSP ID: ENSP00000421255
MVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 24291 - protein, 213 aa, Homo sapiens
  Payload ID: 4848
  Gene Symbol: DKK2
  Gene Name: dickkopf WNT signaling pathway inhibitor 2
  ENSP ID: ENSP00000423797
MTLRIDYCQGLLVGVSSSGLNIIQIQCQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 24292 - protein, 350 aa, Homo sapiens
  Payload ID: 4849
  Gene Symbol: DKK3
  Gene Name: dickkopf WNT signaling pathway inhibitor 3
  Uniprot ID: Q9UBP4
  ENSP ID: ENSP00000314910
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALREPAAAAAALLGGEEI

SEQ ID NO: 24293 - protein, 350 aa, Homo sapiens; identical to SEQ ID NO: 24292
  Payload ID: 4849
  Gene Symbol: DKK3
  Gene Name: dickkopf WNT signaling pathway inhibitor 3
  Uniprot ID: Q9UBP4
  ENSP ID: ENSP00000379762

SEQ ID NO: 24294 - protein, 132 aa, Homo sapiens
  Payload ID: 4849
  Gene Symbol: DKK3
  Gene Name: dickkopf WNT signaling pathway inhibitor 3
  ENSP ID: ENSP00000431604
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQ

SEQ ID NO: 24295 - protein, 364 aa, Homo sapiens
  Payload ID: 4849
  Gene Symbol: DKK3
  Gene Name: dickkopf WNT signaling pathway inhibitor 3
  ENSP ID: ENSP00000433112
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHRLPRLEPGFVPSLPSHSLVYVCKPTFVGSRDQDGEILLPREVPDEYEVGSFMEEVRQELEDLERSLTEEMALREPAAAAAALLGGEEI

SEQ ID NO: 24296 - protein, 234 aa, Homo sapiens
  Payload ID: 4849
  Gene Symbol: DKK3
  Gene Name: dickkopf WNT signaling pathway inhibitor 3
  ENSP ID: ENSP00000435269
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPL

SEQ ID NO: 24297 - protein, 183 aa, Homo sapiens
  Payload ID: 4849
  Gene Symbol: DKK3
  Gene Name: dickkopf WNT signaling pathway inhibitor 3
  ENSP ID: ENSP00000436645
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQFASFQYTCQPCRGQRMLCTRDSECCGDQLCVWGHCTKMATRGSNGTICDNQ

SEQ ID NO: 24298 - protein, 224 aa, Homo sapiens
  Payload ID: 4850
  Gene Symbol: DKK4
  Gene Name: dickkopf WNT signaling pathway inhibitor 4
  Uniprot ID: Q9UBT3
  ENSP ID: ENSP00000220812
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 24299 - protein, 242 aa, Homo sapiens
  Payload ID: 4851
  Gene Symbol: DKKL1
  Gene Name: dickkopf-like 1
  Uniprot ID: Q9UK85
  ENSP ID: ENSP00000221498
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 24300 - protein, 100 aa, Homo sapiens
  Payload ID: 4851
  Gene Symbol: DKKL1
  Gene Name: dickkopf-like 1
  ENSP ID: ENSP00000469865
MEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 24301 - protein, 125 aa, Homo sapiens
  Payload ID: 4851
  Gene Symbol: DKKL1
  Gene Name: dickkopf-like 1
  ENSP ID: ENSP00000470676
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAI

SEQ ID NO: 24302 - protein, 137 aa, Homo sapiens
  Payload ID: 4851
  Gene Symbol: DKKL1
  Gene Name: dickkopf-like 1
  ENSP ID: ENSP00000471812
  MOD_RES (1)..(1): Any amino acid
XAAAPIHDADAQESSLGLTGLQSLLQGFSRLFLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 24303 - protein, 199 aa, Homo sapiens
  Payload ID: 4851
  Gene Symbol: DKKL1
  Gene Name: dickkopf-like 1
  ENSP ID: ENSP00000472056
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKT

SEQ ID NO: 24304 - protein, 145 aa, Homo sapiens
  Payload ID: 4851
  Gene Symbol: DKKL1
  Gene Name: dickkopf-like 1
  ENSP ID: ENSP00000472866
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESS

SEQ ID NO: 24305 - protein, 377 aa, Homo sapiens
  Payload ID: 4852
  Gene Symbol: DMBX1
  Gene Name: diencephalon/mesencephalon homeobox 1
  Uniprot ID: Q8NFW5
  ENSP ID: ENSP00000353132
MQHYGVNGYSLHAMNSLSAMYNLHQQAAQQAQHAPDYRPSVHALTLAERLADIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSPLSLFRLQEQFRQHMAATNNLVHYSSFEVGGPAPAAAAAAAAVPYLGVNMAPLGSLHCQSYYQSLSAAAAAHQGVWGSPLLPAPPAGLAPASATLNSKTTSIENLRLRAKQHAASLGLDTLPN

SEQ ID NO: 24306 - protein, 382 aa, Homo sapiens
  Payload ID: 4852
  Gene Symbol: DMBX1
  Gene Name: diencephalon/mesencephalon homeobox 1
  Uniprot ID: Q8NFW5
  ENSP ID: ENSP00000361024
MQHYGVNGYSLHAMNSLSAMYNLHQQAAQQAQHAPDYRPSVHALTLAERLAGCTFQDIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSPLSLFRLQEQFRQHMAATNNLVHYSSFEVGGPAPAAAAAAAAVPYLGVNMAPLGSLHCQSYYQSLSAAAAAHQGVWGSPLLPAPPAGLAPASATLNSKTTSIENLRLRAKQHAASLGLDTLPN

SEQ ID NO: 24307 - protein, 512 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000268676
MAILSLRAPGPWQAMQVWADRTLLTPHTGVTSQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 24308 - protein, 197 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000412784
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 24309 - protein, 134 aa, Homo sapiens
  Payload ID: 4853
  Gene Symbol: DEF8
  Gene Name: differentially expressed in FDCP 8 homolog (mouse)
  ENSP ID: ENSP00000454478
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIR

SEQ ID NO: 24310 - protein, 177 aa, Homo sapiens
  Payload ID: 4853
  Gene Symbol: DEF8
  Gene Name: differentially expressed in FDCP 8 homolog (mouse)
  ENSP ID: ENSP00000454534
MRGGGQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLN

SEQ ID NO: 24311 - protein, 66 aa, Homo sapiens
  Payload ID: 4853
  Gene Symbol: DEF8
  Gene Name: differentially expressed in FDCP 8 homolog (mouse)
  ENSP ID: ENSP00000454930
MEYDEKLARFRQAHLNPFNKQSGPRQHEQGPGEEVPDVTPEEALPELPPGEPEFRCPERVMDLGLS

SEQ ID NO: 24312 - protein, 107 aa, Homo sapiens
  Payload ID: 4853
  Gene Symbol: DEF8
  Gene Name: differentially expressed in FDCP 8 homolog (mouse)
  ENSP ID: ENSP00000455654
MEYDEKLARFRQAHLNPFNKQSGPRQHEQGPGEEVPDVTPEEALPELPPGEPEFRCPERVMDLGLSEDHFSRPVDGPLTAPAPNLGRVCSWPLTSSSCGRRSRSASR

SEQ ID NO: 24313 - protein, 127 aa, Homo sapiens
  Payload ID: 4853
  Gene Symbol: DEF8
  Gene Name: differentially expressed in FDCP 8 homolog (mouse)
  ENSP ID: ENSP00000455783
MEYDEKLARFRQAHLNPFNKQSGPRQHEQGPGEEVPDVTPEEALPELPPGEPEFRCPERVMDLGLSEDHFSRPVQLRQAIEECKQVILELPEQSEKQKDAVVRLIHLRLKLQELKDPNEDEPNIRVL

SEQ ID NO: 24314 - protein, 125 aa, Homo sapiens
  Payload ID: 4853
  Gene Symbol: DEF8
  Gene Name: differentially expressed in FDCP 8 homolog (mouse)
  ENSP ID: ENSP00000455987
MDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLI

SEQ ID NO: 24315 - protein, 391 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000456095
MDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 24316 - protein, 106 aa, Homo sapiens
  Payload ID: 4853
  Gene Symbol: DEF8
  Gene Name: differentially expressed in FDCP 8 homolog (mouse)
  ENSP ID: ENSP00000456157
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQ

SEQ ID NO: 24317 - protein, 451 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000456501
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 24318 - protein, 176 aa, Homo sapiens
  Payload ID: 4853
  Gene Symbol: DEF8
  Gene Name: differentially expressed in FDCP 8 homolog (mouse)
  ENSP ID: ENSP00000456706
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKRCQAKGFVCELCREGDVLFPFDSHTSVCADCSAVFHRDCYYDNSTTCPKCAR

SEQ ID NO: 24319 - protein, 441 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000456799
MEYDEKLARFRQAHLNPFNKQSGPRQHEQGPGEEVPDVTPEEALPELPPGEPEFRCPERVMDLGLSEDHFSRPVLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 24320 - protein, 136 aa, Homo sapiens
  Payload ID: 4853
  Gene Symbol: DEF8
  Gene Name: differentially expressed in FDCP 8 homolog (mouse)
  ENSP ID: ENSP00000456954
MAILSLRAPGPWQAMQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPN

SEQ ID NO: 24321 - protein, 150 aa, Homo sapiens
  Payload ID: 4853
  Gene Symbol: DEF8
  Gene Name: differentially expressed in FDCP 8 homolog (mouse)
  ENSP ID: ENSP00000457072
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVK

SEQ ID NO: 24322 - protein, 186 aa, Homo sapiens
  Payload ID: 4853
  Gene Symbol: DEF8
  Gene Name: differentially expressed in FDCP 8 homolog (mouse)
  ENSP ID: ENSP00000457309
MRGGGQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQT

SEQ ID NO: 24323 - protein, 434 aa, Homo sapiens
  Payload ID: 4853
  Gene Symbol: DEF8
  Gene Name: differentially expressed in FDCP 8 homolog (mouse)
  Uniprot ID: Q6ZN54
  ENSP ID: ENSP00000457627
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 24324 - protein, 451 aa, Homo sapiens; identical to SEQ ID NO: 24317
  Payload ID: 4853
  Gene Symbol: DEF8
  Gene Name: differentially expressed in FDCP 8 homolog (mouse)
  Uniprot ID: Q6ZN54
  ENSP ID: ENSP00000458019

SEQ ID NO: 24325 - protein, 197 aa, Homo sapiens; identical to SEQ ID NO: 24308
  Payload ID: 4853
  Gene Symbol: DEF8
  Gene Name: differentially expressed in FDCP 8 homolog (mouse)
  Uniprot ID: Q6ZN54
  ENSP ID: ENSP00000480073

SEQ ID NO: 24326 - protein, 451 aa, Homo sapiens; identical to SEQ ID NO: 24317
  Payload ID: 4853
  Gene Symbol: DEF8
  Gene Name: differentially expressed in FDCP 8 homolog (mouse)
  Uniprot ID: Q6ZN54
  ENSP ID: ENSP00000482524

SEQ ID NO: 24327 - protein, 517 aa, Homo sapiens
  Payload ID: 4854
  Gene Symbol: DPCR1
  Gene Name: diffuse panbronchiolitis critical region 1
  Uniprot ID: Q3MIW9
  ENSP ID: ENSP00000305948
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 24328 - protein, 507 aa, Homo sapiens
  Payload ID: 4854
  Gene Symbol: DPCR1
  Gene Name: diffuse panbronchiolitis critical region 1
  ENSP ID: ENSP00000392132
PLANEKTTLSPAEPTENGERTPFTNEKTTPSSAEPTEHGERTPLANEITTPSRAEPTEHGERIANEKATPSPAKPTEHGETTVNEDTTPSSAEPTENGERTPLANENTTTSPTESTEHGERTANEKTTPSPAEPTEHGERTPSANEKTIPSPAKPTEHEEMTPSANENTTPSPVKPTEHGEKTTLANEKITLSPEGPTEHGAKTTSANEKITPSLAKPTEHGERTTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNKSHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 24329 - protein, 507 aa, Homo sapiens
  Payload ID: 4854
  Gene Symbol: DPCR1
  Gene Name: diffuse panbronchiolitis critical region 1
  ENSP ID: ENSP00000402773
PLANEKTTLSPAEPTENGERTPFTNEKTTPSSAEPTEHGERTPLANEITTPSRAEPTEHGERIANEKATPSPAKPTEHGETTVNEDTTPSSAEPTENGERTPLANENTTTSPTESTEHGERTANEKTTPSPAEPTEHGERTPSANEKTIPSPAKPTEHEEMTPSANENTTPSPVKPTEHGEKTTLANEKITLSPEGPTEHGAKTTSANEKITPSLAKPTEHGERTTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 24330 - protein, 507 aa, Homo sapiens; identical to SEQ ID NO: 24329
  Payload ID: 4854
  Gene Symbol: DPCR1
  Gene Name: diffuse panbronchiolitis critical region 1
  ENSP ID: ENSP00000409587

SEQ ID NO: 24331 - protein, 1393 aa, Homo sapiens
  Payload ID: 4854
  Gene Symbol: DPCR1
  Gene Name: diffuse panbronchiolitis critical region 1
  ENSP ID: ENSP00000417182
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENTTLSPAEPIENRERTANENTAPFPAGPTENREMTANENTTLFPAEPTEHGERTANENTTPSPAEPTEHGERTANENTTPSPAEPTEHGERTPFANDKTTSSSAESTEHGERTPLANENTTPSPAEPTENRERTANENTTPSPAGPTENRETTANEKTTLSPVEPTENRETTANEKTTPSPAEPTENGQRTPFANEKTTSSSAEPTEHGERTPLANENTTPSPAEPTENRERTANEKTTPSPAEPTENGDRTPLANEKTTPSLAEPTENGQRTPFANEKTTSSSAEPTEHEERTPLANENTTPSPAEPTENRERTANENTTPSPAGPTENREMTANEKTTLFPAEPTENRERTANEKTTSSPAEPTENGQRTPFANEKTTSSSAEPTEHGERTPLANENTTLSPAEPTENRERTANEKTTPFPAEPTENRERTANENTTPSPAQPTENGDRTPLANEKTTPSLAEPTENGKRTPFANEKTTSSSAEPTEHAERTPLANENTTSSPAEPTENRERTANEKTTQFPAEPTENRESTANEKTTPFPAEPTENREWTANENTTLSPAEPTEHEEMTPLANEKTTLSPAEPTENGERTPFTNEKTTPSSAEPTEHGERTPLANEITTPSRAEPTEHGERIANEKATPSPAKPTEHGETTVNEDTTPSSAEPTENGERTPLANENTTTSPTESTEHGERTANEKTTPSPAEPTEHGERTPSANEKTIPSPAKPTEHEEMTPSANENTTPSPVKPTEHGEKTTLANEKITLSPEGPTEHGAKTTSANEKITPSLAKPTEHGERTTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 24332 - protein, 517 aa, Homo sapiens; identical to SEQ ID NO: 24327
  Payload ID: 4854
  Gene Symbol: DPCR1
  Gene Name: diffuse panbronchiolitis critical region 1
  Uniprot ID: Q3MIW9
  ENSP ID: ENSP00000446847

SEQ ID NO: 24333 - protein, 889 aa, Homo sapiens
  Payload ID: 4854
  Gene Symbol: DPCR1
  Gene Name: diffuse panbronchiolitis critical region 1
  ENSP ID: ENSP00000446930
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENTTLSPAEPTENRERTANENTAPFPAGPTENREMTANENTTLFPAEPTEHGERTANENTTPSPAEPTEHGERTANENTTPSPAEPTEHGERTPFANDKTTSSSAESTEHGERTPLANENTTPSPAEPTENRERTANENTTPSPAGPTENRETTANEKTTLSPVEPTENRETTANEKTTPSPAEPTENGQRTPFANEKTTSSSAEPTEHGERTPLANENTTPSPAEPTENRERTANEKTTPSPAEPTENGDRTPLANEKTTPSLAEPTENGQRTPFANEKTTSSSAEPTEHEERTPLANENTTPSPAEPTENRERTANENTTPSPAGPTENREMTANEKTTLFPAEPTENRERTANEKTTSSPAEPTENGQRTPFANEKTTSSSAEPTEHGERTPLANENTTLSPAGPTENRERTANEKTTPFPAEPTENRERTANENTTPSPAQPTENGDRTPLANEKTTPSLAEPTENGKRTPFANEKTTSSSAEPTEHAERTPLANENTTSSPAEPTENRERTANEKTTQFPAEPTENRESTANEKTTPFPAEPTENREWTANENTTLSPAEPTEHEEMTPLA

SEQ ID NO: 24334 - protein, 517 aa, Homo sapiens; identical to SEQ ID NO: 24327
  Payload ID: 4854
  Gene Symbol: DPCR1
  Gene Name: diffuse panbronchiolitis critical region 1
  Uniprot ID: Q3MIW9
  ENSP ID: ENSP00000448383

SEQ ID NO: 24335 - protein, 517 aa, Homo sapiens
  Payload ID: 4854
  Gene Symbol: DPCR1
  Gene Name: diffuse panbronchiolitis critical region 1
  ENSP ID: ENSP00000480788
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNKSHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 24336 - protein, 476 aa, Homo sapiens
  Payload ID: 4855
  Gene Symbol: DGCR14
  Gene Name: DiGeorge syndrome critical region gene 14
  Uniprot ID: Q96DF8
  ENSP ID: ENSP00000252137
METPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 24337 - protein, 293 aa, Homo sapiens
  Payload ID: 4855
  Gene Symbol: DGCR14
  Gene Name: DiGeorge syndrome critical region gene 14
  ENSP ID: ENSP00000388524
METPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQGPSLSFSKKAANPRAPALP

SEQ ID NO: 24338 - protein, 550 aa, Homo sapiens
  Payload ID: 4856
  Gene Symbol: DGCR2
  Gene Name: DiGeorge syndrome critical region gene 2
  Uniprot ID: P98153
  ENSP ID: ENSP00000263196
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 24339 - protein, 326 aa, Homo sapiens
  Payload ID: 4856
  Gene Symbol: DGCR2
  Gene Name: DiGeorge syndrome critical region gene 2
  ENSP ID: ENSP00000373914
MSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 24340 - protein, 509 aa, Homo sapiens
  Payload ID: 4856
  Gene Symbol: DGCR2
  Gene Name: DiGeorge syndrome critical region gene 2
  Uniprot ID: P98153
  ENSP ID: ENSP00000440062
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 24341 - protein, 550 aa, Homo sapiens [sequence omitted]

SEQ ID NO: 24342 - protein, 328 aa, Homo sapiens
  Payload ID: 4856
  Gene Symbol: DGCR2
  Gene Name: DiGeorge syndrome critical region gene 2
  ENSP ID: ENSP00000482494
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSNLRKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQHPLSCTARAT

SEQ ID NO: 24343 - protein, 220 aa, Homo sapiens; identical to SEQ ID NO: 991
  Payload ID: 4857
  Gene Symbol: DGCR6
  Gene Name: DiGeorge syndrome critical region gene 6
  Uniprot ID: Q14129
  ENSP ID: ENSP00000331681

SEQ ID NO: 24344 - protein, 162 aa, Homo sapiens
  Payload ID: 4857
  Gene Symbol: DGCR6
  Gene Name: DiGeorge syndrome critical region gene 6
  Uniprot ID: Q14129
  ENSP ID: ENSP00000397633
MERYAGALEEVADGARQQERHYQLLSALQSLVKELPSSFQQRLSYTTLSDLALALLDGTVFEIVQGLLEIQHLTEKSLYNQRLRLQNEHRVPRTFWNPLETCRDSGVGGWRRLASSPVQTPLWPGCSAGLCSGRRCGRSTRKPSRPAGPITCLCFRRLSSEN

SEQ ID NO: 24345 - protein, 84 aa, Homo sapiens
  Payload ID: 4857
  Gene Symbol: DGCR6
  Gene Name: DiGeorge syndrome critical region gene 6
  ENSP ID: ENSP00000402409
MDQKIVLELDRKVADQQSTLEKAGVAGFYVTTNPQELMLQMNLLELIRKLQQRGCWAGKAALGLGGPWQLPAAQCDQKGSPVPP

SEQ ID NO: 24346 - protein, 144 aa, Homo sapiens
  Payload ID: 4857
  Gene Symbol: DGCR6
  Gene Name: DiGeorge syndrome critical region gene 6
  ENSP ID: ENSP00000466276
MERYAGALEEVADGARQQERHYQLLSALQSLVKELPSSFQQRLSYTTLSDLALALLDGTVFEIVQGLLEIQHLTEKSLYNQRLRLQNEHRGARGQREEVPPPRGRRLPAALGICAARLLPWECSEEVPKINKIKGAETETAPFW

SEQ ID NO: 24347 - protein, 104 aa, Homo sapiens
  Payload ID: 4857
  Gene Symbol: DGCR6
  Gene Name: DiGeorge syndrome critical region gene 6
  ENSP ID: ENSP00000467483
MERYAGALEEVADGARQQERHYQLLSALQSLLIPAALVLHHAERPGPGASRRHRVRNRAGATGDPAPHRKEPVQPAPAPTERASSAQAGAAAEAPGSPAGLPAP

SEQ ID NO: 24348 - protein, 144 aa, Homo sapiens; identical to SEQ ID NO: 24346
  Payload ID: 4857
  Gene Symbol: DGCR6
  Gene Name: DiGeorge syndrome critical region gene 6
  ENSP ID: ENSP00000476388

SEQ ID NO: 24349 - protein, 220 aa, Homo sapiens
  Payload ID: 4858
  Gene Symbol: DGCR6L
  Gene Name: DiGeorge syndrome critical region gene 6-like
  Uniprot ID: Q9BY27
  ENSP ID: ENSP00000248879
MERYAAALEEVADGARQQERHYQLLSALQSLVKELPSSFQQRLSYTTLSDLALALLDGTVFEIVQGLLEIQHLTEKSLYNQRLRLQNEHRVLRQALRQKHQEAQQACRPHNLPVVQAAQQRELEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 24350 - protein, 182 aa, Homo sapiens
  Payload ID: 4858
  Gene Symbol: DGCR6L
  Gene Name: DiGeorge syndrome critical region gene 6-like
  ENSP ID: ENSP00000386052
MERYAAALEEVADGARQQERHYQLLSALQSLVKELPSACPTPRSATWPWRFSTAPCSKSCRGYWRSSTSPKRACTTSACAYRTSTEAVEHRIREEQRAMDQKIILELDRKVADQQSTLEKAGVAGFYVTTNPQELMLQMNLLELIRKLQQRGCRAGNAALGLGGPWQSPAAQCDQKGSPVPP

SEQ ID NO: 24351 - protein, 97 aa, Homo sapiens
  Payload ID: 4858
  Gene Symbol: DGCR6L
  Gene Name: DiGeorge syndrome critical region gene 6-like
  ENSP ID: ENSP00000403341
MERYAAALEEVADGARQQERHYQLLSALQSLVKELPSSFQQRLSYTTLSDLALALLDGTVFEIVQGLLEIQHLTEKSLYNQRLRLQNEHRGRGTPDP

SEQ ID NO: 24352 - protein, 248 aa, Homo sapiens
  Payload ID: 4859
  Gene Symbol: DIEXF
  Gene Name: digestive organ expansion factor homolog (zebrafish)
  ENSP ID: ENSP00000407345
  MOD_RES (1)..(1): Any amino acid
XCSTWSFLAPLPQQFHLKILFLPLTPLRLLLLSAQVLIVVPFREAALRVVQLFISLLEGDSKKKIIVSNKKRFQGEYGSDPEERPPNLKRPEDYEAVFVGNIDDHFRIGVAILQRSIRLYAPFYSSDILIASPLGLRTIIGGEGEKKRDFDFLSSIELLIIDQADIYLMQNWEHVLHLMNHMNLLPLDSHGVDFSRVRMWSLNNWSKYYRQTLLFGALQDAQINSVFNKYCVNMQGQVGSRLVSSVSS

SEQ ID NO: 24353 - protein, 756 aa, Homo sapiens
  Payload ID: 4859
  Gene Symbol: DIEXF
  Gene Name: digestive organ expansion factor homolog (zebrafish)
  Uniprot ID: Q68CQ4
  ENSP ID: ENSP00000419005
MGKRGSRSQSQLLNTLTKKQKKHLRDFGEEHPFYDRVSRKEAKPQICQLSESSDSSDSESDSESEPQQVSGYHRLLATLKNVSEEEEEDEEEEEEEDSIVDDAEMNDEDGGSDVSVEEEMAAESTESPENVALSADPEGKEDGEEPPGTSQTSPEEFTDAKHESLFSLETNFLEEESGDNSSLKASQDPFLQHVNKELKEKAIQAVATNPKTTHELKWPILGQLFFSSKFQKLETFKPPKDIDLKSLHLQKPLESTWTKTNSQFLSGPQKSSSPFTPLQKELFLIMNSYRDLFYPERTALKNGEEIRHVYCLHVINHILKANAQVLGNNSRRRSQKFGVGDDDDFRDQGLTRPKVLIVVPFREAALRVVQLFISLLEGDSKKKIIVSNKKRFQGEYGSDPEERPPNLKRPEDYEAVFVGNIDDHFRIGVAILQRSIRLYAPFYSSDILIASPLGLRTIIGGEGEKKRDFDFLSSIELLIIDQADIYLMQNWEHVLHLMNHMNLLPLDSHGVDFSRVRMWSLNNWSKYYRQTLLFGALQDAQINSVFNKYCVNMQGQVAVRNVPMTGSISHVLVQLPHVFQRMEAENLASVIDARFNFFVNKILPQYRDAVMSHTLIYIPSYFDFVRLRNYFKKEELNFTHICEYTQKSGVSRARHFFLQGEKQFLLFTERFHFYKRYTIKGIRNLIFYELPTYPHFYSEICNMLRATNRGEEATWTCTVLYSKYDAQRLAAVVGVERAAQMLQSNKNVHLFITGEK

SEQ ID NO: 24354 - protein, 334 aa, Homo sapiens
  Payload ID: 4860
  Gene Symbol: DHDH
  Gene Name: dihydrodiol dehydrogenase (dimeric)
  Uniprot ID: Q9UQ10
  ENSP ID: ENSP00000221403
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGVDDTVTVLLQYPGEVHGSFTCSITVQLSNTASVSGTKGMVQLLNPCWCPTELVVKGEHKEFPLPPVPKDCNFDNGAGMSYEAKHVWECLRKGMKESPVIPLSESELLADILEEVRKAIGVTFPQDKR

SEQ ID NO: 24355 - protein, 242 aa, Homo sapiens
  Payload ID: 4860
  Gene Symbol: DHDH
  Gene Name: dihydrodiol dehydrogenase (dimeric)
  ENSP ID: ENSP00000428672
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGMKESPVIPLSESELLADILEEVRKAIGVTFPQDKR

SEQ ID NO: 24356 - protein, 195 aa, Homo sapiens
  Payload ID: 4860
  Gene Symbol: DHDH
  Gene Name: dihydrodiol dehydrogenase (dimeric)
  ENSP ID: ENSP00000428935
MALRWGIVSVGLISSDFTAVLQTLPRSEHQVVAVAARDLSRAKEFAQKHDIPKAYGSYEELAKDPSVGVDDTVTVLLQYPGEVHGSFTCSITVQLSNTASVSGTKGMVQLLNPCWCPTELVVKGEHKEFPLPPVPKDCNFDNGAGMSYEAKHVWECLRKGMKESPVIPLSESELLADILEEVRKAIGVTFPQDKR

SEQ ID NO: 24357 - protein, 137 aa, Homo sapiens
  Payload ID: 4860
  Gene Symbol: DHDH
  Gene Name: dihydrodiol dehydrogenase (dimeric)
  ENSP ID: ENSP00000430360
ISSDFTAVLQTLPRSEHQVVAVAARDLSRAKEFAQKHDIPKAYGSYEELAKDPSVGHLDPLLSCLRGSEVCFGPGNSRRPPGGSGRIWEESHPRSPGRRPGPGWGGPAGHRHLLCPVHLHGLWRAEAREDFCRGKAS

SEQ ID NO: 24358 - protein, 187 aa, Homo sapiens
  Payload ID: 4861
  Gene Symbol: DHFR
  Gene Name: dihydrofolate reductase
  Uniprot ID: P00374
  ENSP ID: ENSP00000396308
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 24359 - protein, 135 aa, Homo sapiens
  Payload ID: 4861
  Gene Symbol: DHFR
  Gene Name: dihydrofolate reductase
  Uniprot ID: P00374
  ENSP ID: ENSP00000421334
MGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 24360 - protein, 129 aa, Homo sapiens
  Payload ID: 4861
  Gene Symbol: DHFR
  Gene Name: dihydrofolate reductase
  ENSP ID: ENSP00000422732
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKIPRCSL

SEQ ID NO: 24361 - protein, 187 aa, Homo sapiens; identical to SEQ ID NO: 24358
  Payload ID: 4861
  Gene Symbol: DHFR
  Gene Name: dihydrofolate reductase
  Uniprot ID: P00374
  ENSP ID: ENSP00000426474

SEQ ID NO: 24362 - protein, 187 aa, Homo sapiens
  Payload ID: 4862
  Gene Symbol: DHFRL1
  Gene Name: dihydrofolate reductase-like 1
  Uniprot ID: Q86XF0
  ENSP ID: ENSP00000319170
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIWIVGGSSVYKEAMNHLGHLKLFVTRIMQDFESDTFFSEIDLEKYKLLPEYPGVLSDVQEGKHIKYKFEVCEKDD

SEQ ID NO: 24363 - protein, 187 aa, Homo sapiens; identical to SEQ ID NO: 24362
  Payload ID: 4862
  Gene Symbol: DHFRL1
  Gene Name: dihydrofolate reductase-like 1
  Uniprot ID: Q86XF0
  ENSP ID: ENSP00000377768

SEQ ID NO: 24364 - protein, 187 aa, Homo sapiens; identical to SEQ ID NO: 24362
  Payload ID: 4862
  Gene Symbol: DHFRL1
  Gene Name: dihydrofolate reductase-like 1
  Uniprot ID: Q86XF0
  ENSP ID: ENSP00000418415

SEQ ID NO: 24365 - protein, 114 aa, Homo sapiens
  Payload ID: 4862
  Gene Symbol: DHFRL1
  Gene Name: dihydrofolate reductase-like 1
  ENSP ID: ENSP00000420810
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIW

SEQ ID NO: 24366 - protein, 187 aa, Homo sapiens; identical to SEQ ID NO: 24362
  Payload ID: 4862
  Gene Symbol: DHFRL1
  Gene Name: dihydrofolate reductase-like 1
  Uniprot ID: Q86XF0
  ENSP ID: ENSP00000480823

SEQ ID NO: 24367 - protein, 320 aa, Homo sapiens
  Payload ID: 4863
  Gene Symbol: DBT
  Gene Name: dihydrolipoamide branched chain transacylase E2
  ENSP ID: ENSP00000359150
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKYYFSWKS

SEQ ID NO: 24368 - protein, 482 aa, Homo sapiens
  Payload ID: 4863
  Gene Symbol: DBT
  Gene Name: dihydrolipoamide branched chain transacylase E2
  Uniprot ID: P11182
  ENSP ID: ENSP00000359151
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVSQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 24369 - protein, 509 aa, Homo sapiens
  Payload ID: 4864
  Gene Symbol: DLD
  Gene Name: dihydrolipoamide dehydrogenase
  Uniprot ID: P09622
  ENSP ID: ENSP00000205402
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 24370 - protein, 461 aa, Homo sapiens
  Payload ID: 4864
  Gene Symbol: DLD
  Gene Name: dihydrolipoamide dehydrogenase
  Uniprot ID: P09622
  ENSP ID: ENSP00000387542
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 24371 - protein, 115 aa, Homo sapiens
  Payload ID: 4864
  Gene Symbol: DLD
  Gene Name: dihydrolipoamide dehydrogenase
  ENSP ID: ENSP00000388077
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIETLG

SEQ ID NO: 24372 - protein, 509 aa, Homo sapiens; identical to SEQ ID NO: 24369
  Payload ID: 4864
  Gene Symbol: DLD
  Gene Name: dihydrolipoamide dehydrogenase
  Uniprot ID: P09622
  ENSP ID: ENSP00000390667

SEQ ID NO: 24373 - protein, 58 aa, Homo sapiens
  Payload ID: 4864
  Gene Symbol: DLD
  Gene Name: dihydrolipoamide dehydrogenase
  ENSP ID: ENSP00000402593
MQSWSRVYCSLAKRGHFNRISHGLQGLSAVPLRTYADQPSFIEQLSLLPYGPWKRFCI

SEQ ID NO: 24374 - protein, 114 aa, Homo sapiens
  Payload ID: 4864
  Gene Symbol: DLD
  Gene Name: dihydrolipoamide dehydrogenase
  ENSP ID: ENSP00000409590
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIENL

SEQ ID NO: 24375 - protein, 486 aa, Homo sapiens
  Payload ID: 4864
  Gene Symbol: DLD
  Gene Name: dihydrolipoamide dehydrogenase
  ENSP ID: ENSP00000417016
MQSWSRVYCSLAKRGHFNRISHGLQGLSAVPLRTYADQPIDADVTVIGSGPGGYVAAIKAAQLGFKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 24376 - protein, 647 aa, Homo sapiens
  Payload ID: 4865
  Gene Symbol: DLAT
  Gene Name: dihydrolipoamide S-acetyltransferase
  Uniprot ID: P10515
  ENSP ID: ENSP00000280346
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 24377 - protein, 542 aa, Homo sapiens
  Payload ID: 4865
  Gene Symbol: DLAT
  Gene Name: dihydrolipoamide S-acetyltransferase
  ENSP ID: ENSP00000376771
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 24378 - protein, 479 aa, Homo sapiens
  Payload ID: 4865
  Gene Symbol: DLAT
  Gene Name: dihydrolipoamide S-acetyltransferase
  ENSP ID: ENSP00000433432
PARRNSVTTGYGGVRALCGWTPSSGATPRNRLLLQLLGSPGRRYYSLPPHQKVPLPSLSPTMQAGTIARWEKKEGDKINEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 24379 - protein, 65 aa, Homo sapiens
  Payload ID: 4865
  Gene Symbol: DLAT
  Gene Name: dihydrolipoamide S-acetyltransferase
  ENSP ID: ENSP00000435374
MWRVCARRAQNVAPWAGLEARWTALQEVPGTPRVTSRSGPAPARRNSVTTGFHCLLFPPQCRQAP

SEQ ID NO: 24380 - protein, 67 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000238671
MLSRSRCVSRAFSRSLSAFQKGNCPLGRRSLPGVSLCQGPGYPNSRKVVINNSVFSVRFFRTTAVCR

SEQ ID NO: 24381 - protein, 453 aa, Homo sapiens
  Payload ID: 4866
  Gene Symbol: DLST
  Gene Name: dihydrolipoamide S-succinyltransferase (E2 component of 2-oxo-glutarate complex)
  Uniprot ID: P36957
  ENSP ID: ENSP00000335304
MLSRSRCVSRAFSRSLSAFQKGNCPLGRRSLPGVSLCQGPGYPNSRKVVINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQPVVNAVIDDTTKEVVYRDYIDISVAVATPRGLVVPVIRNVEAMNFADIERTITELGEKARKNELAIEDMDGGTFTISNGGVFGSLFGTPIINPPQSAILGMHGIFDRPVAIGGKVEVRPMMYVALTYDHRLIDGREAVTFLRKIKAAVEDPRVLLLDL

SEQ ID NO: 24382 - protein, 104 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000451210
MLSRSRCVSRAFSRSLSAFQKGNCPLGRRSLPGVSLCQGPGYPNSRKVVINNSVFSVRFFRTTAVCKDDLVTVKTPAFAESVTEGDVRWEKDICAGSITSKWRD

SEQ ID NO: 24383 - protein, 74 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000451425
  MOD_RES (1)..(1): Any amino acid
XVSLCQGPGYPNSRKVVINNSVFSVRFFRTTAVCKDDLVTVKTPAFAESVTEGDVRWEKAFDCLFSCWRHSCRR

SEQ ID NO: 24384 - protein, 37 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000451670
MLSRSRCVSRAFSRSLSAFQKGSPYARDQVTLTAGRL

SEQ ID NO: 24385 - protein, 279 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000451957
AVPIPLCVSGVQPLALRLPEGELPSRETFPACINNSVFSVRFFRTTAVCKDDLVTVKTPAFAESVTEGDVRWEKAVGDTVAEDEVVCEIETDKTSVQVPSPANGVIEALLVPDGGKVEGGTPLFTLRKTGAAPAKAKPAEAPAAAAPKAEPTAAAVPPPAAPIPTQMPPVPSPSQPPSGKPVSAVKPTVAPPLAEPGAGKGLRSEHREKMNRMRQRIAQRLKEAQNTCAMLTTFNEIDMSNIQEMRARHKEAFLKKHNLKLGFMSAFVKASAFALQEQP

SEQ ID NO: 24386 - protein, 110 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000452417
MLSRSRCVSRAFSRSLSAFQKGSPYARDQVTLTAGRLSLTTVSSVFAFSELQLYARMTWLQSKPQRLQNLSQREMSGGRKLLETQLQKMKWFVRLKLTRHLCRFHHQQMA

SEQ ID NO: 24387 - protein, 83 aa, Homo sapiens
  Payload ID: 4866
  Gene Symbol: DLST
  Gene Name: dihydrolipoamide S-succinyltransferase (E2 component of 2-oxo-glutarate complex)
  ENSP ID: ENSP00000452422
MLSRSRCVSRAFSRSLSAFQKGNCPLGRRSLPALTTVSSVFAFSELQLYADDLVTVKTPAFAESVTEGDVRWEKGSITSKWRD

SEQ ID NO: 24388 - protein, 83 aa, Homo sapiens; identical to SEQ ID NO: 24387
  Payload ID: 4866
  Gene Symbol: DLST
  Gene Name: dihydrolipoamide S-succinyltransferase (E2 component of 2-oxo-glutarate complex)
  ENSP ID: ENSP00000487251

SEQ ID NO: 24389 - protein, 395 aa, Homo sapiens
  Payload ID: 4867
  Gene Symbol: DHODH
  Gene Name: dihydroorotate dehydrogenase (quinone)
  Uniprot ID: Q02127
  ENSP ID: ENSP00000219240
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 24390 - protein, 193 aa, Homo sapiens
  Payload ID: 4867
  Gene Symbol: DHODH
  Gene Name: dihydroorotate dehydrogenase (quinone)
  ENSP ID: ENSP00000460966
  MOD_RES (1)..(1): Any amino acid
XWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEESRALAESQMPLEQIIGGEDSV

SEQ ID NO: 24391 - protein, 393 aa, Homo sapiens
  Payload ID: 4867
  Gene Symbol: DHODH
  Gene Name: dihydroorotate dehydrogenase (quinone)
  ENSP ID: ENSP00000461848
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQVPIIGVGGVSSGQDALEKIRAGASLVQLYTALTFWGPPVVGKVKRELEALLKEQGFGGVTDAIGADHRR

SEQ ID NO: 24392 - protein, 76 aa, Homo sapiens
  Payload ID: 4867
  Gene Symbol: DHODH
  Gene Name: dihydroorotate dehydrogenase (quinone)
  ENSP ID: ENSP00000464249
  MOD_RES (1)..(1): Any amino acid
XLKKRAQDAVIILGGGGLLFASYLMATGDERFYAEHLMPTLQGLLDPESAHRLAVRFTSLGLLPRARFQDSDMLAC

SEQ ID NO: 24393 - protein, 144 aa, Homo sapiens
  Payload ID: 4867
  Gene Symbol: DHODH
  Gene Name: dihydroorotate dehydrogenase (quinone)
  ENSP ID: ENSP00000464333
MATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTE

SEQ ID NO: 24394 - protein, 519 aa, Homo sapiens
  Payload ID: 4868
  Gene Symbol: DPYS
  Gene Name: dihydropyrimidinase
  Uniprot ID: Q14117
  ENSP ID: ENSP00000276651
MAAPSRLLIRGGRVVNDDFSEVADVLVEDGVVRALGHDLLPPGGAPAGLRVLDAAGKLVLPGGIDTHTHMQFPFMGSRSIDDFHQGTKAALSGGTTMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRTISAKTHHQAVNFNIFEGMVCHGVPLVTISRGKVVYEAGVFSVTAGDGKFIPRKPFAEYIYKRIKQRDRTCTPTPVERAPYKGEVATLKSRVTKEDATAGTRKQAHP

SEQ ID NO: 24395 - protein, 150 aa, Homo sapiens
  Payload ID: 4868
  Gene Symbol: DPYS
  Gene Name: dihydropyrimidinase
  ENSP ID: ENSP00000430246
MAAPSRLLIRGGRVVNDDFSEVADVLVEDGVVRALGHDLLPPGGAPAGLRVLDAAGKLVLPGGIDTHTHMQFPFMGSRSIDDFHQGTKVKEEMKILVQDKGVNSFKMFMAYKDLYMVTDLELYEAFSRCKEIGAIAQVHAENGDLIAEGA

SEQ ID NO: 24396 - protein, 54 aa, Homo sapiens
  Payload ID: 4868
  Gene Symbol: DPYS
  Gene Name: dihydropyrimidinase
  ENSP ID: ENSP00000436654
  MOD_RES (1)..(1): Any amino acid
XGDGKFIPRKPFAEYIYKRIKQRDRVKKSEERRLPFPSQPNIVNPWRSRPYSTP

SEQ ID NO: 24397 - protein, 572 aa, Homo sapiens
  Payload ID: 4869
  Gene Symbol: DPYSL2
  Gene Name: dihydropyrimidinase-like 2
  Uniprot ID: Q16555
  ENSP ID: ENSP00000309539
MSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 24398 - protein, 170 aa, Homo sapiens
  Payload ID: 4869
  Gene Symbol: DPYSL2
  Gene Name: dihydropyrimidinase-like 2
  ENSP ID: ENSP00000427954
MPPSRLGVGRVSSGLSFPAARRLHAGQIPSLQPPPGPRPFPAPRSRARTLPGSSRPLRGRAWPGPPRRVPARRRSSPQPRQGGGQSDRLLIKGGKIVNDDQSFYADIYMEDGLIKQIGENLIVPGGVKTIEAHSRMVIPGGIDVHTRFQMPDQGMTSADDFFQGTKAALA

SEQ ID NO: 24399 - protein, 536 aa, Homo sapiens
  Payload ID: 4869
  Gene Symbol: DPYSL2
  Gene Name: dihydropyrimidinase-like 2
  Uniprot ID: Q16555
  ENSP ID: ENSP00000427985
MEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 24400 - protein, 536 aa, Homo sapiens; identical to SEQ ID NO: 24399
  Payload ID: 4869
  Gene Symbol: DPYSL2
  Gene Name: dihydropyrimidinase-like 2
  Uniprot ID: Q16555
  ENSP ID: ENSP00000431117

SEQ ID NO: 24401 - protein, 684 aa, Homo sapiens
  Payload ID: 4870
  Gene Symbol: DPYSL3
  Gene Name: dihydropyrimidinase-like 3
  Uniprot ID: Q14195
  ENSP ID: ENSP00000343690
MASGRRGWDSSHEDDLPVYLARPGTTDQVPRQKYGGMFCNVEGAFESKTLDFDALSVGQRGAKTPRSGQGSDRGSGSRPGIEGDTPRRGQGREESREPAPASPAPAGVEIRSATGKEVLQNLGPKDKSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 24402 - protein, 570 aa, Homo sapiens
  Payload ID: 4870
  Gene Symbol: DPYSL3
  Gene Name: dihydropyrimidinase-like 3
  Uniprot ID: Q14195
  ENSP ID: ENSP00000381526
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 24403 - protein, 92 aa, Homo sapiens
  Payload ID: 4870
  Gene Symbol: DPYSL3
  Gene Name: dihydropyrimidinase-like 3
  ENSP ID: ENSP00000426720
MSYQGKKNIPRITSDRLLIKGGRIVNDDQSFYADIYMEDGLIKQIGDNLIVPGGVKTIEANGKMVIPGGIDVHTHFQMPYKGMTTVDDFFQG

SEQ ID NO: 24404 - protein, 75 aa, Homo sapiens
  Payload ID: 4870
  Gene Symbol: DPYSL3
  Gene Name: dihydropyrimidinase-like 3
  ENSP ID: ENSP00000428958
ADLISQARKKGNVVFGEPITASLGIDGTHYWSKNWAKAAAFVTSPPLSPDPTTPDYINSLLARPQGKWTKTSSWL

SEQ ID NO: 24405 - protein, 209 aa, Homo sapiens
  Payload ID: 4870
  Gene Symbol: DPYSL3
  Gene Name: dihydropyrimidinase-like 3
  ENSP ID: ENSP00000430267
  MOD_RES (1)..(1): Any amino acid
XTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 24406 - protein, 572 aa, Homo sapiens
  Payload ID: 4871
  Gene Symbol: DPYSL4
  Gene Name: dihydropyrimidinase-like 4
  Uniprot ID: O14531
  ENSP ID: ENSP00000339850
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 24407 - protein, 412 aa, Homo sapiens
  Payload ID: 4871
  Gene Symbol: DPYSL4
  Gene Name: dihydropyrimidinase-like 4
  ENSP ID: ENSP00000357616
MPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 24408 - protein, 564 aa, Homo sapiens
  Payload ID: 4872
  Gene Symbol: DPYSL5
  Gene Name: dihydropyrimidinase-like 5
  Uniprot ID: Q9BPU6
  ENSP ID: ENSP00000288699
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQGKVVLAETTTAHATLTGLHYYHQDWSHAAAYVTVPPLRLDTNTSTYLMSLLANDTLNIVASDHRPFTTKQKAMGKEDFTKIPHGVSGVQDRMSVIWERGVVGGKMDENRFVAVTSSNAAKLLNLYPRKGRIIPGADADVVVWDPEATKTISASTQVQGGDFNLYENMRCHGVPLVTISRGRVVYENGVFMCAEGTGKFCPLRSFPDTVYKKLVQREKTLKVRGVDRTPYLGDVAVVVHPGKKEMGTPLADTPTRPVTRHGGMRDLHESSFSLSGSQIDDHVPKRASARILAPPGGRSSGIW

SEQ ID NO: 24409 - protein, 564 aa, Homo sapiens; identical to SEQ ID NO: 24408
  Payload ID: 4872
  Gene Symbol: DPYSL5
  Gene Name: dihydropyrimidinase-like 5
  Uniprot ID: Q9BPU6
  ENSP ID: ENSP00000385549

SEQ ID NO: 24410 - protein, 189 aa, Homo sapiens
  Payload ID: 4872
  Gene Symbol: DPYSL5
  Gene Name: dihydropyrimidinase-like 5
  ENSP ID: ENSP00000399581
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIAR

SEQ ID NO: 24411 - protein, 165 aa, Homo sapiens
  Payload ID: 4872
  Gene Symbol: DPYSL5
  Gene Name: dihydropyrimidinase-like 5
  ENSP ID: ENSP00000407174
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKD

SEQ ID NO: 24412 - protein, 174 aa, Homo sapiens
  Payload ID: 4872
  Gene Symbol: DPYSL5
  Gene Name: dihydropyrimidinase-like 5
  ENSP ID: ENSP00000413075
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSEL

SEQ ID NO: 24413 - protein, 564 aa, Homo sapiens; identical to SEQ ID NO: 24408
  Payload ID: 4872
  Gene Symbol: DPYSL5
  Gene Name: dihydropyrimidinase-like 5
  Uniprot ID: Q9BPU6
  ENSP ID: ENSP00000481305

SEQ ID NO: 24414 - protein, 173 aa, Homo sapiens
  Payload ID: 4873
  Gene Symbol: DPYD
  Gene Name: dihydropyrimidine dehydrogenase
  Uniprot ID: Q12882
  ENSP ID: ENSP00000307107
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATETLILAFSLMNHL

SEQ ID NO: 24415 - protein, 1025 aa, Homo sapiens
  Payload ID: 4873
  Gene Symbol: DPYD
  Gene Name: dihydropyrimidine dehydrogenase
  Uniprot ID: Q12882
  ENSP ID: ENSP00000359211
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 24416 - protein, 473 aa, Homo sapiens
  Payload ID: 4874
  Gene Symbol: DUS1L
  Gene Name: dihydrouridine synthase 1-like
  Uniprot ID: Q6P1R4
  ENSP ID: ENSP00000303515
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKGNRCVFSLCRGCCKKRASKETADCPGHGLLFKTKLEKSLAWKEAQPELQEPQPAAPGTPGGFSEVMGSALA

SEQ ID NO: 24417 - protein, 473 aa, Homo sapiens; identical to SEQ ID NO: 24416
  Payload ID: 4874
  Gene Symbol: DUS1L
  Gene Name: dihydrouridine synthase 1-like
  Uniprot ID: Q6P1R4
  ENSP ID: ENSP00000346280

SEQ ID NO: 24418 - protein, 239 aa, Homo sapiens
  Payload ID: 4874
  Gene Symbol: DUS1L
  Gene Name: dihydrouridine synthase 1-like
  ENSP ID: ENSP00000438718
  MOD_RES (1)..(1): Any amino acid
XSRQEGAKPTGDLPFHWICQPYIRPGPREGSKEKAGARSKRALEEEEGGTEVLSKNKQKKQLRNPHKTFDPSLKPKYAKCDQCGNPKVSGFRLQATKASALGVGRVVSALLGVAGLVPAQLGLQRGSRWHGCLRTAPCFQPSPCPGLEGKRVWVGGGEGEASGLGAVPRAASRPWASGRGFPSGAAPLLASLAPGVVLATGSRDFLCPGQQMCVQPVPRLLQEASLQRDCRLPRSRIAF

SEQ ID NO: 24419 - protein, 298 aa, Homo sapiens
  Payload ID: 4874
  Gene Symbol: DUS1L
  Gene Name: dihydrouridine synthase 1-like
  ENSP ID: ENSP00000445110
  MOD_RES (1)..(1): Any amino acid
XLLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKMCVQPVPRLLQEASLQRDCRLPRSRIAF

SEQ ID NO: 24420 - protein, 191 aa, Homo sapiens
  Payload ID: 4874
  Gene Symbol: DUS1L
  Gene Name: dihydrouridine synthase 1-like
  ENSP ID: ENSP00000462526
  MOD_RES (1)..(1): Any amino acid
XNGNIQCLQDVERCLRDTGVQGVMSAGGQGPGQQPGPHAHGLIPPPRGQPAQPRPVRGPEPCRVGAGRGVSGHRAGAPLPPVLRPGPPLQAVAPHAAGAPGAARGAGQGEDPGGHRCCEPGAEAAVSGRRYPGRRERSPPATCPSTGSASPTSGRGPGRGARRRQVRAASGPWRKRRVARRSCPRTSKRSS

SEQ ID NO: 24421 - protein, 152 aa, Homo sapiens
  Payload ID: 4874
  Gene Symbol: DUS1L
  Gene Name: dihydrouridine synthase 1-like
  ENSP ID: ENSP00000462812
  MOD_RES (1)..(1): Any amino acid
XPREGSKEKAGARSKRALEEEEGGTEVLSKNKQKKQLRNPHKTFDPSLKPKYAKCDQCGNPKGNRCVFSLCRGCCKKRASKETADCPGLLLEPGHVLLKKMPFTQGISCYLMWKDTPMSPFGPLWGPGNAAVGSRPQAGPALSSARVCKSEQ

SEQ ID NO: 24422 - protein, 247 aa, Homo sapiens
  Payload ID: 4874
  Gene Symbol: DUS1L
  Gene Name: dihydrouridine synthase 1-like
  ENSP ID: ENSP00000463180
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRVLLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHP

SEQ ID NO: 24423 - protein, 309 aa, Homo sapiens
  Payload ID: 4874
  Gene Symbol: DUS1L
  Gene Name: dihydrouridine synthase 1-like
  ENSP ID: ENSP00000463509
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELK

SEQ ID NO: 24424 - protein, 152 aa, Homo sapiens
  Payload ID: 4874
  Gene Symbol: DUS1L
  Gene Name: dihydrouridine synthase 1-like
  ENSP ID: ENSP00000463797
MPKLQGFEFWSRTLRGARHVVAPMVDQSELAWRLLSRRHGAQLCYTPMLHAQVFVRDANYRKENLYCEVCPEDRPLIVQAALLAQDYCDAIDLNLGCPQMIAKRGHYGAFLQDEWDLLQRMILLAHEKLSVPVTCKIRVFPEIDKTVRYAQM

SEQ ID NO: 24425 - protein, 301 aa, Homo sapiens
  Payload ID: 4874
  Gene Symbol: DUS1L
  Gene Name: dihydrouridine synthase 1-like
  ENSP ID: ENSP00000463962
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAGGQGPGQQPGPHAHGLIPPPRGQPAQPRPVRGPEPCRVGAGRGVSGHRAGAPLPPVLRPGPPLQAVAPH

SEQ ID NO: 24426 - protein, 493 aa, Homo sapiens
  Payload ID: 4875
  Gene Symbol: DUS2
  Gene Name: dihydrouridine synthase 2
  Uniprot ID: Q9NX74
  ENSP ID: ENSP00000351769
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 24427 - protein, 458 aa, Homo sapiens
  Payload ID: 4875
  Gene Symbol: DUS2
  Gene Name: dihydrouridine synthase 2
  ENSP ID: ENSP00000409498
MILNSLSLCYHNKLILAPMVRVGTLPMRLLALDYGADIVYCEELIDLKMIQCKRVVNEVLSTVDFVAPDDRVVFRTCEREQNRVVFQMGGMGAALLSDPDKIEKILSTLVKGTRRPVTCKIRILPSLEDTLSLVKRIERTGIAAIAVHGRKREERPQHPVSCEVIKAIADTLSIPVIANGGSHDHIQQYSDIEDFRQATAASSVMVARAAMWNPSIFLKEGLRPLEEVMQKYIRYAVQYDNHYTNTKYCLCQMLREQLESPQGRLLHAAQSSREICEAFGLGAFYEETTQELDAQQARLSAKTSEQTGEPAEDTSGVIKMAVKFDRRAYPAQITPKMCLLEWCRREKLAQPVYETVQRPLDRLFSSIVTVAEQKYQSTLWDKSKKLAEQAAAIVCLRSQGLPEGRLGEESPSLHKRKREAPDQDPGGPRAQELAQPGDLCKKPFVALGSGEESPLEGW

SEQ ID NO: 24428 - protein, 115 aa, Homo sapiens
  Payload ID: 4875
  Gene Symbol: DUS2
  Gene Name: dihydrouridine synthase 2
  ENSP ID: ENSP00000454252
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMG

SEQ ID NO: 24429 - protein, 81 aa, Homo sapiens
  Payload ID: 4875
  Gene Symbol: DUS2
  Gene Name: dihydrouridine synthase 2
  ENSP ID: ENSP00000454424
MILNSLSLCYHNKLILAPMVRVGTLPMRLLALDYGADIVYCEELIDLKMIQCKRVVNEVLSTVDFVAPDDRVVFRTCEREQ

SEQ ID NO: 24430 - protein, 493 aa, Homo sapiens; identical to SEQ ID NO: 24426
  Payload ID: 4875
  Gene Symbol: DUS2
  Gene Name: dihydrouridine synthase 2
  Uniprot ID: Q9NX74
  ENSP ID: ENSP00000455229

SEQ ID NO: 24431 - protein, 107 aa, Homo sapiens
  Payload ID: 4875
  Gene Symbol: DUS2
  Gene Name: dihydrouridine synthase 2
  ENSP ID: ENSP00000455977
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDV

SEQ ID NO: 24432 - protein, 41 aa, Homo sapiens
  Payload ID: 4875
  Gene Symbol: DUS2
  Gene Name: dihydrouridine synthase 2
  ENSP ID: ENSP00000456261
MILNSLSLCYHNKLILAPMVRVGTLPMRLLALDYGADIVYC

SEQ ID NO: 24433 - protein, 51 aa, Homo sapiens
  Payload ID: 4875
  Gene Symbol: DUS2
  Gene Name: dihydrouridine synthase 2
  ENSP ID: ENSP00000456677
MILNSLSLCYHNKLILAPMVRVGTLPMRLLALDYGADIVYCEELIDLKMIQ

SEQ ID NO: 24434 - protein, 87 aa, Homo sapiens
  Payload ID: 4875
  Gene Symbol: DUS2
  Gene Name: dihydrouridine synthase 2
  ENSP ID: ENSP00000457292
MILNSLSLCYHNKLILAPMVRVGTLPMRLLALDYGADIVYCERCSAQWTLSPLMIELSSAPVKESRTGWSSRWGLQTQSEPLLWPGL

SEQ ID NO: 24435 - protein, 73 aa, Homo sapiens
  Payload ID: 4875
  Gene Symbol: DUS2
  Gene Name: dihydrouridine synthase 2
  ENSP ID: ENSP00000458152
MILNSLSLCYHNKLILAPMVRVGTLPMRLLALDYGADIVYCEELIDLKMIQCKRVVNEVLSTVDFVAPDDRVV

SEQ ID NO: 24436 - protein, 88 aa, Homo sapiens
  Payload ID: 4875
  Gene Symbol: DUS2
  Gene Name: dihydrouridine synthase 2
  ENSP ID: ENSP00000458906
MILNSLSLCYHNKLILAPMVRVGTLPMRLLALDYGADIVYCEELIDLKMIQCKRVVNEVLSTVDFVAPDDRVVFRTCEREQNRVVFQM

SEQ ID NO: 24437 - protein, 123 aa, Homo sapiens
  Payload ID: 4875
  Gene Symbol: DUS2
  Gene Name: dihydrouridine synthase 2
  ENSP ID: ENSP00000461244
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTK

SEQ ID NO: 24438 - protein, 158 aa, Homo sapiens
  Payload ID: 4875
  Gene Symbol: DUS2
  Gene Name: dihydrouridine synthase 2
  ENSP ID: ENSP00000461659
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRI

SEQ ID NO: 24439 - protein, 208 aa, Homo sapiens
  Payload ID: 4875
  Gene Symbol: DUS2
  Gene Name: dihydrouridine synthase 2
  ENSP ID: ENSP00000463498
MILNSLSLCYHNKLILAPMVRVGTLPMRLLALDYGADIVYCEELIDLKMIQCKRVVNEVLSTVDFVAPDDRVVFRTCEREQNRVVFQMGTSDAERALAVARLVENDVAGIDVNMGCPKQYSTKGGMGAALLSDPDKIEKILSTLVKGTRRPVTCKIRILPSLEDTLSLVKRIERTGIAAIAVHGRKREERPQHPVSCEVIKAIADTLS

SEQ ID NO: 24440 - protein, 650 aa, Homo sapiens
  Payload ID: 4876
  Gene Symbol: DUS3L
  Gene Name: dihydrouridine synthase 3-like
  Uniprot ID: Q96G46
  ENSP ID: ENSP00000311977
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 24441 - protein, 408 aa, Homo sapiens
  Payload ID: 4876
  Gene Symbol: DUS3L
  Gene Name: dihydrouridine synthase 3-like
  Uniprot ID: Q96G46
  ENSP ID: ENSP00000315558
MAEGTAEAPLENGGGGDSGAGALERGVAPIKRQYLTTKEQFHQFLEAKGQEKTCRETELDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 24442 - protein, 217 aa, Homo sapiens
  Payload ID: 4876
  Gene Symbol: DUS3L
  Gene Name: dihydrouridine synthase 3-like
  ENSP ID: ENSP00000465369
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRTWCRRSWRPAGPSPRPSATAWTKPCSSSCGSARSASSELSRPCAGSARAPHPLPLSPRARQPRALPGRKTVVPSRSPQGRALAPLPAAPCGPAGP

SEQ ID NO: 24443 - protein, 169 aa, Homo sapiens
  Payload ID: 4876
  Gene Symbol: DUS3L
  Gene Name: dihydrouridine synthase 3-like
  ENSP ID: ENSP00000466351
  MOD_RES (1)..(1): Any amino acid
XKEQRHWDISSSERLDILRDFTNYGLEHWGSDTQGVEKTRRFLLEWLSFLCRYVPVGLLERLPQRINERPPYYLGRDYLETLMASQKAADWIRIRCLGGLELGSCSRGPGVTEGTLQVLGLTSLSTCSPTARCSLGQCPPASPSCRSTRPTRTSSLRLSQGHPGARRVQ

SEQ ID NO: 24444 - protein, 77 aa, Homo sapiens
  Payload ID: 4876
  Gene Symbol: DUS3L
  Gene Name: dihydrouridine synthase 3-like
  ENSP ID: ENSP00000467302
TEVGDPAGNELAEPEAKRIRLEDGQTADGQTEEAAEPGEQLQTQKRARGQNKGRPHVKPTNYDKNRLCPSLIQAIGC

SEQ ID NO: 24445 - protein, 171 aa, Homo sapiens
  Payload ID: 4876
  Gene Symbol: DUS3L
  Gene Name: dihydrouridine synthase 3-like
  ENSP ID: ENSP00000467987
CGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTEMGTSCHLRMPTAPCRLVSPGS

SEQ ID NO: 24446 - protein, 139 aa, Homo sapiens
  Payload ID: 4876
  Gene Symbol: DUS3L
  Gene Name: dihydrouridine synthase 3-like
  ENSP ID: ENSP00000468075
  MOD_RES (1)..(1): Any amino acid
XGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTPGSLGLFLSASHSLPPTLRGGFSPSSTAALGSSATPS

SEQ ID NO: 24447 - protein, 37 aa, Homo sapiens
  Payload ID: 4876
  Gene Symbol: DUS3L
  Gene Name: dihydrouridine synthase 3-like
  ENSP ID: ENSP00000468233
MREGHHVHARADTSPPRSSFTNSWKPKGRRRLAGKPR

SEQ ID NO: 24448 - protein, 317 aa, Homo sapiens
  Payload ID: 4877
  Gene Symbol: DUS4L
  Gene Name: dihydrouridine synthase 4-like
  Uniprot ID: O95620
  ENSP ID: ENSP00000265720
MKSDCMQTTICQERKKDPIEMFHSGQLVKVCAPMVRYSKLAFRTLVRKYSCDLCYTPMIVAADFVKSIKARDSEFTTNQGDCPLIVQFAANDARLLSDAARIVCPYANGIDINCGCPQRWAMAEGYGACLINKPELVQDMVKQVRNQVETPGFSVSIKIRIHDDLKRTVDLCQKAEATGVSWITVHGRTAEERHQPVHYDSIKIIKENMSIPVIANGDIRSLKEAENVWRITGTDGVMVARGLLANPAMFAGYEETPLKCIWDWVDIALELGTPYMCFHQHLMYMMEKITSRQEKRVFNALSSTSAIIDYLTDHYGI

SEQ ID NO: 24449 - protein, 119 aa, Homo sapiens
  Payload ID: 4877
  Gene Symbol: DUS4L
  Gene Name: dihydrouridine synthase 4-like
  ENSP ID: ENSP00000388061
MKSDCMQTTICQERKKDPIEMFHSGQLVKVCAPMVRYSKLAFRTLVRKYSCDLCYTPMIVAADFVKSIKARDSEFTTNQGDCPLIVQFAANDARLLSDAARIVCPYANGIDINCGCPQR

SEQ ID NO: 24450 - protein, 90 aa, Homo sapiens
  Payload ID: 4877
  Gene Symbol: DUS4L
  Gene Name: dihydrouridine synthase 4-like
  ENSP ID: ENSP00000388904
MKSDCMQTTICQERKKDPIEMFHSGQLVKVCAPMVRYSKLAFRTLVRKYSCDLCYTPMIVAADFVKSIKARDSEFTTNQGGQWQKVMGLA

SEQ ID NO: 24451 - protein, 48 aa, Homo sapiens
  Payload ID: 4877
  Gene Symbol: DUS4L
  Gene Name: dihydrouridine synthase 4-like
  ENSP ID: ENSP00000399375
MKSDCMQTTICQERKKDPIEMFHSGQLVKVCAPMVRYSKRWKFYHIKL

SEQ ID NO: 24452 - protein, 90 aa, Homo sapiens; identical to SEQ ID NO: 24450
  Payload ID: 4877
  Gene Symbol: DUS4L
  Gene Name: dihydrouridine synthase 4-like
  ENSP ID: ENSP00000402887

SEQ ID NO: 24453 - protein, 90 aa, Homo sapiens; identical to SEQ ID NO: 24450
  Payload ID: 4877
  Gene Symbol: DUS4L
  Gene Name: dihydrouridine synthase 4-like
  ENSP ID: ENSP00000412739

SEQ ID NO: 24454 - protein, 313 aa, Homo sapiens
  Payload ID: 4878
  Gene Symbol: DIMT1
  Gene Name: DIM1 dimethyladenosine transferase 1 homolog
  Uniprot ID: Q9UNQ2
  ENSP ID: ENSP00000199320
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIIIPEDFSIADKIQQILTSTGFSDKRARSMDIDDFIRLLHGFNAEGIHFS

SEQ ID NO: 24455 - protein, 275 aa, Homo sapiens
  Payload ID: 4878
  Gene Symbol: DIMT1
  Gene Name: DIM1 dimethyladenosine transferase 1 homolog
  ENSP ID: ENSP00000421754
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRCAILMFQREFALRLVAKPGDKLYCRLSINTQLLARVDHLMKVGKNNFRPPPKVESSVVRIEPKNPPPPINFQEWDGLVRITFVRKNKTLSAAFKSSAVQQLLEKNYRIHCSVHNIVSAAVYPVKQI

SEQ ID NO: 24456 - protein, 154 aa, Homo sapiens
  Payload ID: 4878
  Gene Symbol: DIMT1
  Gene Name: DIM1 dimethyladenosine transferase 1 homolog
  ENSP ID: ENSP00000427193
MPKVKSGAIGRRRGRQEQRRELKSAGGLMFNTGIGQHILKNPLIINSIIDKAALRPTDVVLEVGPGTGNMTVKLLEKAKKVVACELDPRLVAELHKRVQGTPVASKLQVLVGDVLKTDLPFFDTCVANLPYQISSPFVFKLLLHRPFFRFVTKD

SEQ ID NO: 24457 - protein, 285 aa, Homo sapiens
  Payload ID: 4879
  Gene Symbol: DDAH1
  Gene Name: dimethylarginine dimethylaminohydrolase 1
  Uniprot ID: O94760
  ENSP ID: ENSP00000284031
MAGLGHPAAFGRATHAVVRALPESLGQHALRSAKGEEVDVARAERQHQLYVGVLGSKLGLQVVELPADESLPDCVFVEDVAVVCEETALITRPGAPSRRKEVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 24458 - protein, 182 aa, Homo sapiens
  Payload ID: 4879
  Gene Symbol: DDAH1
  Gene Name: dimethylarginine dimethylaminohydrolase 1
  Uniprot ID: O94760
  ENSP ID: ENSP00000411189
MMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 24459 - protein, 285 aa, Homo sapiens; identical to SEQ ID NO: 24457
  Payload ID: 4879
  Gene Symbol: DDAH1
  Gene Name: dimethylarginine dimethylaminohydrolase 1
  Uniprot ID: O94760
  ENSP ID: ENSP00000438604

SEQ ID NO: 24460 - protein, 182 aa, Homo sapiens; identical to SEQ ID NO: 24458
  Payload ID: 4879
  Gene Symbol: DDAH1
  Gene Name: dimethylarginine dimethylaminohydrolase 1
  Uniprot ID: O94760
  ENSP ID: ENSP00000439045

SEQ ID NO: 24461 - protein, 185 aa, Homo sapiens
  Payload ID: 4879
  Gene Symbol: DDAH1
  Gene Name: dimethylarginine dimethylaminohydrolase 1
  ENSP ID: ENSP00000488725
MVDMMKEALEKLQLNIVEMKDENATLDGGDVLFTGREFFVGLSKRTNQRGAEILADTFKDYAVSTVPVADGLHLKSFCSMAGPNLIAIGSSESAQKALKIMQQMSDHRYDKLTVPDDIAANCIYLNIPNKGHVLLHRTPEEYPESAKVYEKLKDHMLIPVSMSELEKVDGLLTCCSVLINKKVDS

SEQ ID NO: 24462 - protein, 285 aa, Homo sapiens
  Payload ID: 4880
  Gene Symbol: DDAH2
  Gene Name: dimethylarginine dimethylaminohydrolase 2
  Uniprot ID: O95865
  ENSP ID: ENSP00000364943
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 24463 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000364945

SEQ ID NO: 24464 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000364949

SEQ ID NO: 24465 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000372901

SEQ ID NO: 24466 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000382935

SEQ ID NO: 24467 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000382936

SEQ ID NO: 24468 - protein, 226 aa, Homo sapiens
  Payload ID: 4880
  Gene Symbol: DDAH2
  Gene Name: dimethylarginine dimethylaminohydrolase 2
  ENSP ID: ENSP00000387943
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPG

SEQ ID NO: 24469 - protein, 236 aa, Homo sapiens
  Payload ID: 4880
  Gene Symbol: DDAH2
  Gene Name: dimethylarginine dimethylaminohydrolase 2
  ENSP ID: ENSP00000388456
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLH

SEQ ID NO: 24470 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000389552

SEQ ID NO: 24471 - protein, 188 aa, Homo sapiens
  Payload ID: 4880
  Gene Symbol: DDAH2
  Gene Name: dimethylarginine dimethylaminohydrolase 2
  ENSP ID: ENSP00000390549
  MOD_RES (1)..(1): Any amino acid
XRRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRMTQLLTVSFFVLGCLVCPLSSCTVEVGICPTARRHCRSSLMSPWYLCPAQNWRRLAPGSAPSAWCSAHAPTAEGLALGYCWPGVG

SEQ ID NO: 24472 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000391632

SEQ ID NO: 24473 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000391833

SEQ ID NO: 24474 - protein, 225 aa, Homo sapiens
  Payload ID: 4880
  Gene Symbol: DDAH2
  Gene Name: dimethylarginine dimethylaminohydrolase 2
  ENSP ID: ENSP00000393967
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRP

SEQ ID NO: 24475 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000394578

SEQ ID NO: 24476 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000395372

SEQ ID NO: 24477 - protein, 226 aa, Homo sapiens; identical to SEQ ID NO: 24468
  Payload ID: 4880
  Gene Symbol: DDAH2
  Gene Name: dimethylarginine dimethylaminohydrolase 2
  ENSP ID: ENSP00000395759

SEQ ID NO: 24478 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000397466

SEQ ID NO: 24479 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000399023

SEQ ID NO: 24480 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000399357

SEQ ID NO: 24481 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000402594

SEQ ID NO: 24482 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000402854
  MOD_RES (1)..(1): Any amino acid

SEQ ID NO: 24483 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000403154

SEQ ID NO: 24484 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000404342

SEQ ID NO: 24485 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000404851

SEQ ID NO: 24486 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000405005

SEQ ID NO: 24487 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000405515

SEQ ID NO: 24488 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000406990
  MOD_RES (1)..(1): Any amino acid

SEQ ID NO: 24489 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000408148

SEQ ID NO: 24490 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000408572

SEQ ID NO: 24491 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000408699
  MOD_RES (1)..(1): Any amino acid

SEQ ID NO: 24492 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000409396

SEQ ID NO: 24493 - protein, 226 aa, Homo sapiens; identical to SEQ ID NO: 24468
  Payload ID: 4880
  Gene Symbol: DDAH2
  Gene Name: dimethylarginine dimethylaminohydrolase 2
  ENSP ID: ENSP00000409450

SEQ ID NO: 24494 - protein, 226 aa, Homo sapiens; identical to SEQ ID NO: 24468
  Payload ID: 4880
  Gene Symbol: DDAH2
  Gene Name: dimethylarginine dimethylaminohydrolase 2
  ENSP ID: ENSP00000410144

SEQ ID NO: 24495 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000411554

SEQ ID NO: 24496 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000412327

SEQ ID NO: 24497 - protein, 285 aa, Homo sapiens; identical to SEQ ID NO: 24462
  Payload ID: 4880
  Gene Symbol: DDAH2
  Gene Name: dimethylarginine dimethylaminohydrolase 2
  Uniprot ID: O95865
  ENSP ID: ENSP00000412800

SEQ ID NO: 24498 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000413164
  MOD_RES (1)..(1): Any amino acid

SEQ ID NO: 24499 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000414074
  MOD_RES (1)..(1): Any amino acid

SEQ ID NO: 24500 - protein, 226 aa, Homo sapiens; identical to SEQ ID NO: 24468
  Payload ID: 4880
  Gene Symbol: DDAH2
  Gene Name: dimethylarginine dimethylaminohydrolase 2
  ENSP ID: ENSP00000414967

SEQ ID NO: 24501 - protein, 236 aa, Homo sapiens; identical to SEQ ID NO: 24469
  Payload ID: 4880
  Gene Symbol: DDAH2
  Gene Name: dimethylarginine dimethylaminohydrolase 2
  ENSP ID: ENSP00000415005

SEQ ID NO: 24502 - protein, 226 aa, Homo sapiens; identical to SEQ ID NO: 24468
  Payload ID: 4880
  Gene Symbol: DDAH2
  Gene Name: dimethylarginine dimethylaminohydrolase 2
  ENSP ID: ENSP00000416012

SEQ ID NO: 24503 - protein, 188 aa, Homo sapiens; identical to SEQ ID NO: 24471
  Payload ID: 4880
  Gene Symbol: DDAH2
  Gene Name: dimethylarginine dimethylaminohydrolase 2
  ENSP ID: ENSP00000416785
  MOD_RES (1)..(1): Any amino acid

SEQ ID NO: 24504 - protein, 866 aa, Homo sapiens
  Payload ID: 4881
  Gene Symbol: DMGDH
  Gene Name: dimethylglycine dehydrogenase
  Uniprot ID: Q9UI17
  ENSP ID: ENSP00000255189
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 24505 - protein, 98 aa, Homo sapiens
  Payload ID: 4881
  Gene Symbol: DMGDH
  Gene Name: dimethylglycine dehydrogenase
  ENSP ID: ENSP00000427834
MLRPGAQLLRGLLLRSCPLQGSPGRPRSVCGREGEEKPPLSAETQWKDRAETVIIGGGCVGVSLAYHLAKAGMKDVVLLEKSELTAGSTWHADFGLVK

SEQ ID NO: 24506 - protein, 50 aa, Homo sapiens
  Payload ID: 4881
  Gene Symbol: DMGDH
  Gene Name: dimethylglycine dehydrogenase
  ENSP ID: ENSP00000428092
MLRPGAQLLRGLLLRSCPLQGSPGRPRSVCGREGFNNLLSSWNKLEENTL

SEQ ID NO: 24507 - protein, 106 aa, Homo sapiens
  Payload ID: 4881
  Gene Symbol: DMGDH
  Gene Name: dimethylglycine dehydrogenase
  ENSP ID: ENSP00000428995
MLRPGAQLLRGLLLRSCPLQGSPGRPRSVCGREGEEKPPLSAETQWKDRAETVIIGGGCVGVSLAYHLAKAGMKDVVLLEKSELTAGSTWHAIWHNPRWWGREISQ

SEQ ID NO: 24508 - protein, 50 aa, Homo sapiens; identical to SEQ ID NO: 24506
  Payload ID: 4881
  Gene Symbol: DMGDH
  Gene Name: dimethylglycine dehydrogenase
  ENSP ID: ENSP00000430133

SEQ ID NO: 24509 - protein, 613 aa, Homo sapiens
  Payload ID: 4881
  Gene Symbol: DMGDH
  Gene Name: dimethylglycine dehydrogenase
  ENSP ID: ENSP00000430972
YLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 24510 - protein, 411 aa, Homo sapiens
  Payload ID: 4882
  Gene Symbol: DPEP1
  Gene Name: dipeptidase 1 (renal)
  Uniprot ID: P16444
  ENSP ID: ENSP00000261615
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 24511 - protein, 411 aa, Homo sapiens; identical to SEQ ID NO: 24510
  Payload ID: 4882
  Gene Symbol: DPEP1
  Gene Name: dipeptidase 1 (renal)
  Uniprot ID: P16444
  ENSP ID: ENSP00000376807

SEQ ID NO: 24512 - protein, 411 aa, Homo sapiens; identical to SEQ ID NO: 24510
  Payload ID: 4882
  Gene Symbol: DPEP1
  Gene Name: dipeptidase 1 (renal)
  Uniprot ID: P16444
  ENSP ID: ENSP00000397313

SEQ ID NO: 24513 - protein, 111 aa, Homo sapiens
  Payload ID: 4882
  Gene Symbol: DPEP1
  Gene Name: dipeptidase 1 (renal)
  ENSP ID: ENSP00000455142
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRM

SEQ ID NO: 24514 - protein, 107 aa, Homo sapiens
  Payload ID: 4882
  Gene Symbol: DPEP1
  Gene Name: dipeptidase 1 (renal)
  ENSP ID: ENSP00000455916
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHR

SEQ ID NO: 24515 - protein, 486 aa, Homo sapiens
  Payload ID: 4883
  Gene Symbol: DPEP2
  Gene Name: dipeptidase 2
  Uniprot ID: Q9H4A9
  ENSP ID: ENSP00000377430
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 24516 - protein, 486 aa, Homo sapiens; identical to SEQ ID NO: 24515
  Payload ID: 4883
  Gene Symbol: DPEP2
  Gene Name: dipeptidase 2
  Uniprot ID: Q9H4A9
  ENSP ID: ENSP00000458977

SEQ ID NO: 24517 - protein, 258 aa, Homo sapiens
  Payload ID: 4883
  Gene Symbol: DPEP2
  Gene Name: dipeptidase 2
  ENSP ID: ENSP00000459375
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEMLWHGGPWKCHRHL

SEQ ID NO: 24518 - protein, 137 aa, Homo sapiens
  Payload ID: 4883
  Gene Symbol: DPEP2
  Gene Name: dipeptidase 2
  ENSP ID: ENSP00000460169
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVP

SEQ ID NO: 24519 - protein, 114 aa, Homo sapiens
  Payload ID: 4883
  Gene Symbol: DPEP2
  Gene Name: dipeptidase 2
  ENSP ID: ENSP00000461250
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSY

SEQ ID NO: 24520 - protein, 122 aa, Homo sapiens
  Payload ID: 4883
  Gene Symbol: DPEP2
  Gene Name: dipeptidase 2
  ENSP ID: ENSP00000462652
MQMIIIWALLDTEAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTV

SEQ ID NO: 24521 - protein, 161 aa, Homo sapiens
  Payload ID: 4883
  Gene Symbol: DPEP2
  Gene Name: dipeptidase 2
  ENSP ID: ENSP00000463604
MKLQTLAVSVTALKFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAP

SEQ ID NO: 24522 - protein, 513 aa, Homo sapiens
  Payload ID: 4884
  Gene Symbol: DPEP3
  Gene Name: dipeptidase 3
  Uniprot ID: Q9H4B8
  ENSP ID: ENSP00000268793
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 24523 - protein, 789 aa, Homo sapiens
  Payload ID: 4885
  Gene Symbol: DPP10
  Gene Name: dipeptidyl-peptidase 10 (non-functional)
  Uniprot ID: Q8N608
  ENSP ID: ENSP00000309066
MRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 24524 - protein, 258 aa, Homo sapiens
  Payload ID: 4885
  Gene Symbol: DPP10
  Gene Name: dipeptidyl-peptidase 10 (non-functional)
  ENSP ID: ENSP00000376854
MVITEVAEGPVDGSEKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVP

SEQ ID NO: 24525 - protein, 800 aa, Homo sapiens
  Payload ID: 4885
  Gene Symbol: DPP10
  Gene Name: dipeptidyl-peptidase 10 (non-functional)
  Uniprot ID: Q8N608
  ENSP ID: ENSP00000376855
MTAAKQEPQPTPGARASQAQPADQELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 24526 - protein, 796 aa, Homo sapiens
  Payload ID: 4885
  Gene Symbol: DPP10
  Gene Name: dipeptidyl-peptidase 10 (non-functional)
  Uniprot ID: Q8N608
  ENSP ID: ENSP00000386565
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 24527 - protein, 746 aa, Homo sapiens
  Payload ID: 4885
  Gene Symbol: DPP10
  Gene Name: dipeptidyl-peptidase 10 (non-functional)
  Uniprot ID: Q8N608
  ENSP ID: ENSP00000387038
MSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 24528 - protein, 60 aa, Homo sapiens
  Payload ID: 4885
  Gene Symbol: DPP10
  Gene Name: dipeptidyl-peptidase 10 (non-functional)
  ENSP ID: ENSP00000391092
MSVILLTPDELTNSSETRLSLEDLFRKDFVLHDPEARWINDTDVVYKSENGHVIKLNIET

SEQ ID NO: 24529 - protein, 97 aa, Homo sapiens
  Payload ID: 4885
  Gene Symbol: DPP10
  Gene Name: dipeptidyl-peptidase 10 (non-functional)
  ENSP ID: ENSP00000402499
MSVILLTPDELTNSSETRLSLEDLFRKDFVLHDPEARWINDTDVVYKSENGHVIKLNIETNATTLLLENTTFVTFKASRHSVSPDLKYVLLAYDVKQ

SEQ ID NO: 24530 - protein, 60 aa, Homo sapiens
  Payload ID: 4885
  Gene Symbol: DPP10
  Gene Name: dipeptidyl-peptidase 10 (non-functional)
  ENSP ID: ENSP00000408535
MRKVESRGEGGREMNSQIRQKPDCLWKTSLGKTLCFTIQRLGGSMIQMWCIKARMDMSLN

SEQ ID NO: 24531 - protein, 170 aa, Homo sapiens
  Payload ID: 4886
  Gene Symbol: DPP3
  Gene Name: dipeptidyl-peptidase 3
  ENSP ID: ENSP00000431606
MADTQYILPNDIGVSSLDCREAFRLLSPTERLYAYHLSRAAWYGGLAVLLQTSPEAPYIYALLSRLFRAQDPDQLRQHALAEGLTEEEYQEKLERVILGSEAAQQHPEEVRGLWQTCGELMFSLEPRLRHLGLGKEGITTYFSGNCTMEDAKLAQDFLDSQNLSAYNTRL

SEQ ID NO: 24532 - protein, 201 aa, Homo sapiens
  Payload ID: 4886
  Gene Symbol: DPP3
  Gene Name: dipeptidyl-peptidase 3
  ENSP ID: ENSP00000432618
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLF

SEQ ID NO: 24533 - protein, 757 aa, Homo sapiens
  Payload ID: 4886
  Gene Symbol: DPP3
  Gene Name: dipeptidyl-peptidase 3
  ENSP ID: ENSP00000432782
MGEPEAGSEFANGAAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 24534 - protein, 177 aa, Homo sapiens
  Payload ID: 4886
  Gene Symbol: DPP3
  Gene Name: dipeptidyl-peptidase 3
  ENSP ID: ENSP00000434518
MGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLA

SEQ ID NO: 24535 - protein, 756 aa, Homo sapiens
  Payload ID: 4886
  Gene Symbol: DPP3
  Gene Name: dipeptidyl-peptidase 3
  ENSP ID: ENSP00000435284
MGEPEAGSEFANGAAAAGPMADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 24536 - protein, 90 aa, Homo sapiens
  Payload ID: 4886
  Gene Symbol: DPP3
  Gene Name: dipeptidyl-peptidase 3
  ENSP ID: ENSP00000436820
MADTQYILPNDIGVSSLDCREAFRLLSPTERLYAYHLSRAAWYGGLAVLLQTSPEAPYIYALLSRLFRAQDPDQLRQHALAEGLTEEEYQ

SEQ ID NO: 24537 - protein, 707 aa, Homo sapiens
  Payload ID: 4886
  Gene Symbol: DPP3
  Gene Name: dipeptidyl-peptidase 3
  Uniprot ID: Q9NY33
  ENSP ID: ENSP00000436941
MADTQYILPNDIGVSSLDCREAFRLLSPTERLYAYHLSRAAWYGGLAVLLQTSPEAPYIYALLSRLFRAQDPDQLRQHALAEGLTEEEYQEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 24538 - protein, 104 aa, Homo sapiens
  Payload ID: 4886
  Gene Symbol: DPP3
  Gene Name: dipeptidyl-peptidase 3
  ENSP ID: ENSP00000437101
MGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDG

SEQ ID NO: 24539 - protein, 737 aa, Homo sapiens
  Payload ID: 4886
  Gene Symbol: DPP3
  Gene Name: dipeptidyl-peptidase 3
  Uniprot ID: Q9NY33
  ENSP ID: ENSP00000440502
MADTQYILPNDIGVSSLDCREAFRLLSPTERLYAYHLSRAAWYGGLAVLLQTSPEAPYIYALLSRLFRAQDPDQLRQHALAEGLTEEEYQAFLVYAAGVYSNMGNYKSFGDTKFVPNLPKEKLERVILGSEAAQQHPEEVRGLWQTCGELMFSLEPRLRHLGLGKEGITTYFSGNCTMEDAKLAQDFLDSQNLSAYNTRLFKEVDGEGKPYYEVRLASVLGSEPSLDSEVTSKLKSYEFRGSPFQVTRGDYAPILQKVVEQLEKAKAYAANSHQGQMLAQYIESFTQGSIEAHKRGSRFWIQDKGPIVESYIGFIESYRDPFGSRGEFEGFVAVVNKAMSAKFERLVASAEQLLKELPWPPTFEKDKFLTPDFTSLDVLTFAGSGIPAGINIPNYDDLRQTEGFKNVSLGNVLAVAYATQREKLTFLEEDDKDLYILWKGPSFDVQVGLHELLGHGSGKLFVQDEKGAFNFDQETVINPETGEQIQSWYRSGETWDSKFSTIASSYEECRAESVGLYLCLHPQVLEIFGFEGADAEDVIYVNWLNMVRAGLLALEFYTPEAFNWRQAHMQARFVILRVLLEAGEGLVTITPTTGSDGRPDARVRLDRSKIRSVGKPALERFLRRLQVLKSTGDVAGGRALYEGYATVTDAPPECFLTLRDTVLLRKESRKLIVQPNTRLEGSDVQLLEYEASAAGLIRSFSERFPEDGPELEEILTQLATADARFWKGPSEAPSGQA

SEQ ID NO: 24540 - protein, 766 aa, Homo sapiens
  Payload ID: 4887
  Gene Symbol: DPP4
  Gene Name: dipeptidyl-peptidase 4
  Uniprot ID: P27487
  ENSP ID: ENSP00000353731
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 24541 - protein, 86 aa, Homo sapiens
  Payload ID: 4887
  Gene Symbol: DPP4
  Gene Name: dipeptidyl-peptidase 4
  ENSP ID: ENSP00000401359
  MOD_RES (1)..(1): Any amino acid
XDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 24542 - protein, 170 aa, Homo sapiens
  Payload ID: 4887
  Gene Symbol: DPP4
  Gene Name: dipeptidyl-peptidase 4
  ENSP ID: ENSP00000402259
MKTPWKVLLGLLGAAALVTIITVPVVLLNKGNDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLVSICLEQ

SEQ ID NO: 24543 - protein, 118 aa, Homo sapiens
  Payload ID: 4887
  Gene Symbol: DPP4
  Gene Name: dipeptidyl-peptidase 4
  ENSP ID: ENSP00000410264
MKTPWKVLLGLLGAAALVTIITVPVVLLNKGTDDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 24544 - protein, 118 aa, Homo sapiens; identical to SEQ ID NO: 24543
  Payload ID: 4887
  Gene Symbol: DPP4
  Gene Name: dipeptidyl-peptidase 4
  ENSP ID: ENSP00000486421

SEQ ID NO: 24545 - protein, 803 aa, Homo sapiens
  Payload ID: 4888
  Gene Symbol: DPP6
  Gene Name: dipeptidyl-peptidase 6
  Uniprot ID: P42658
  ENSP ID: ENSP00000328226
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 24546 - protein, 865 aa, Homo sapiens
  Payload ID: 4888
  Gene Symbol: DPP6
  Gene Name: dipeptidyl-peptidase 6
  Uniprot ID: P42658
  ENSP ID: ENSP00000367001
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 24547 - protein, 353 aa, Homo sapiens
  Payload ID: 4888
  Gene Symbol: DPP6
  Gene Name: dipeptidyl-peptidase 6
  ENSP ID: ENSP00000384393
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPMKKVKSRKLTLPHSKSCDSLAVSQACSPACHQGCFLHYITMSLPLHCLRDYVSAVNGYSTALPACHVQGGPVSDIPWRPWLEDCRRVPGGRTANGTRLRSHAPAALRQHCPLSYECGRCEASHLLTPGIMHSSYRQISGQRATE

SEQ ID NO: 24548 - protein, 801 aa, Homo sapiens
  Payload ID: 4888
  Gene Symbol: DPP6
  Gene Name: dipeptidyl-peptidase 6
  ENSP ID: ENSP00000385578
MKEKAMIKTAKMQGNVMELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 24549 - protein, 758 aa, Homo sapiens
  Payload ID: 4888
  Gene Symbol: DPP6
  Gene Name: dipeptidyl-peptidase 6
  ENSP ID: ENSP00000397303
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 24550 - protein, 291 aa, Homo sapiens
  Payload ID: 4888
  Gene Symbol: DPP6
  Gene Name: dipeptidyl-peptidase 6
  ENSP ID: ENSP00000477855
MTTAKEPSASGKSVQQQEQELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPMKKVKSRKLTLPHSKSCDSLAVSQACSPACHQGCFLHYITMSLPLHCLRDYVSAVNGYSTALPACHVQGGPVSDIPWRPWLEDCRRVPGGRTANGTRLRSHAPAALRQHCPLSYECGRCEASHLLTPGIMHSSYRQISGQRATE

SEQ ID NO: 24551 - protein, 492 aa, Homo sapiens [sequence omitted]

SEQ ID NO: 24552 - protein, 244 aa, Homo sapiens
  Payload ID: 4889
  Gene Symbol: DPP7
  Gene Name: dipeptidyl-peptidase 7
  ENSP ID: ENSP00000473309
  MOD_RES (1)..(1): Any amino acid
XTVRWEFGTCQPLSDEKDLTQLFMFARNAFTVLAMMDYPYPTDFLGPLPANPVKVGCDRLLSEAQRITGLRALAGALPPAPDGCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 24553 - protein, 61 aa, Homo sapiens
  Payload ID: 4889
  Gene Symbol: DPP7
  Gene Name: dipeptidyl-peptidase 7
  ENSP ID: ENSP00000473354
  MOD_RES (1)..(1): Any amino acid
XSGSEHCYDIYRLYHSCADPTGCGTGPDARAWDYQISEPPATSSSPTGTWTPGQGAGFGGT

SEQ ID NO: 24554 - protein, 120 aa, Homo sapiens
  Payload ID: 4889
  Gene Symbol: DPP7
  Gene Name: dipeptidyl-peptidase 7
  ENSP ID: ENSP00000473364
  MOD_RES (1)..(1): Any amino acid
XVLLLALGLRGLQAGARRAPDPGFQERFFQQRLDHFNFERFGNKTFPQRFLVSGSGSGARGPSSSTLGTRATCGPSPTTRPSSRSWRPSGGLYWSSRSTATTGSRCRSVRSPRSAGTRSC

SEQ ID NO: 24555 - protein, 155 aa, Homo sapiens
  Payload ID: 4889
  Gene Symbol: DPP7
  Gene Name: dipeptidyl-peptidase 7
  ENSP ID: ENSP00000473430
  MOD_RES (1)..(1): Any amino acid
XTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGSLRHGPLGVRHLPAAVRREGPDPALHVRPECLHRAGHDGLPLPH

SEQ ID NO: 24556 - protein, 272 aa, Homo sapiens
  Payload ID: 4889
  Gene Symbol: DPP7
  Gene Name: dipeptidyl-peptidase 7
  ENSP ID: ENSP00000473618
APWAPVLLLALGLRGLQAGARRAPDPGFQERFFQQRLDHFNFERFGNKTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGRKPSHLSSQPPAQLGCAATLAAFPSESCTRTWPRVGICGSQKCRPPCGTCGPLRRKRGNGVLGAAALTLCPSPSYGGMLSAYLRMKYPHLVAGALAASAPVLAVAGLGDSNQFF

SEQ ID NO: 24557 - protein, 882 aa, Homo sapiens
  Payload ID: 4890
  Gene Symbol: DPP8
  Gene Name: dipeptidyl-peptidase 8
  Uniprot ID: Q6V1X1
  ENSP ID: ENSP00000300141
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 24558 - protein, 847 aa, Homo sapiens
  Payload ID: 4890
  Gene Symbol: DPP8
  Gene Name: dipeptidyl-peptidase 8
  Uniprot ID: Q6V1X1
  ENSP ID: ENSP00000318111
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 24559 - protein, 898 aa, Homo sapiens
  Payload ID: 4890
  Gene Symbol: DPP8
  Gene Name: dipeptidyl-peptidase 8
  Uniprot ID: Q6V1X1
  ENSP ID: ENSP00000339208
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 24560 - protein, 782 aa, Homo sapiens
  Payload ID: 4890
  Gene Symbol: DPP8
  Gene Name: dipeptidyl-peptidase 8
  Uniprot ID: Q6V1X1
  ENSP ID: ENSP00000351817
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 24561 - protein, 729 aa, Homo sapiens
  Payload ID: 4890
  Gene Symbol: DPP8
  Gene Name: dipeptidyl-peptidase 8
  ENSP ID: ENSP00000379013
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADPDWIAFIHSNDIWISNIVTREERRLTYVHNELANMEEDARSAGVATFVLQEEFDRYSGYWWCPKAETTPSGGKILRILYEENDESEVEIIHVTSPMLETRRADSFRYPKTGTANPKVTFKMSEIMIDAEGRIIDVIDKELIQPFEILFEGVEYIARAGWTPEGKYAWSILLDRSQTRLQIVLISPELFIPVEDDVMERQRLIESVPDSVTPLIIYEETTDIWINIHDIFHVFPQSHEEEIEFIFASECKTGFRHLYKITSILKESKYKRSSGGLPAPSDFKCPIKEEIAITSGEWEVLGRHGSNIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMEALNATF

SEQ ID NO: 24562 - protein, 361 aa, Homo sapiens
  Payload ID: 4890
  Gene Symbol: DPP8
  Gene Name: dipeptidyl-peptidase 8
  ENSP ID: ENSP00000452643
  MOD_RES (1)..(1): Any amino acid
XEEDARSAGVATFVLQEEFDRYSGYWWCPKAETTPSGGKILRILYEENDESEVEIIHVTSPMLETRRADSFRYPKTGTANPKVTFKMSEIMIDAEGRIQVDEVRRLVYFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQVQLVNNRFKGVKYFRLNTLASLGYVVVVIDNRGSCHRGLKFEGAFKYKMGQIEIDDQVEGLQYLASRYDFIDLDRVGIHGWSYGGYLSLMALMQRSDIFRVAIAGAPVTLWIFYDTGYT

SEQ ID NO: 24563 - protein, 219 aa, Homo sapiens
  Payload ID: 4890
  Gene Symbol: DPP8
  Gene Name: dipeptidyl-peptidase 8
  ENSP ID: ENSP00000452719
MCLVFLGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQATLDYGMYSREEELLRERKRIGTVGIASYDYHQGSGTFLFQAGSGIYHVKDGGPQGFTQQPLRPNLVETSCPNIRMDPKLCPADP

SEQ ID NO: 24564 - protein, 84 aa, Homo sapiens
  Payload ID: 4890
  Gene Symbol: DPP8
  Gene Name: dipeptidyl-peptidase 8
  ENSP ID: ENSP00000453756
MAAAMETEQLGVEIFETADCEENIESQDRPKLEPFYVERYSWSQLKKLLADTRKYHGYMMAKAPHDFMFVKRNDPDGPHSDRIY

SEQ ID NO: 24565 - protein, 120 aa, Homo sapiens
  Payload ID: 4890
  Gene Symbol: DPP8
  Gene Name: dipeptidyl-peptidase 8
  ENSP ID: ENSP00000453870
MWKRSEQMKIKSGKCNMAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPK

SEQ ID NO: 24566 - protein, 898 aa, Homo sapiens; identical to SEQ ID NO: 24559
  Payload ID: 4890
  Gene Symbol: DPP8
  Gene Name: dipeptidyl-peptidase 8
  Uniprot ID: Q6V1X1
  ENSP ID: ENSP00000453954

SEQ ID NO: 24567 - protein, 311 aa, Homo sapiens
  Payload ID: 4890
  Gene Symbol: DPP8
  Gene Name: dipeptidyl-peptidase 8
  ENSP ID: ENSP00000454922
  MOD_RES (1)..(1): Any amino acid
XFEGTKDSPLEHHLYVVSYVNPGEVTRLTDRGYSHSCCISQHCDFFISKYSNQKNPHCVSLYKLSSPEDDPTCKTKEFWATILDSAGPLPDYTPPEIFSFESTTGFTLYGMLYKPHDLQPGKKYPTVLFIYGGPQGQIEIDDQVEGLQYLASRYDFIDLDRVGIHGWSYGGYLSLMALMQRSDIFRVAIAGAPVTLWIFYDTGYTERYMGHPDQNEQGYYLGSVAMQAEKFPSEPNRLLLLHGFLDENVHFAHTSILLSFLVRAGKPYDLQIYPQERHSIRVPESGEHYELHLLHYLQENLGSRIAALKVI

SEQ ID NO: 24568 - protein, 162 aa, Homo sapiens
  Payload ID: 4890
  Gene Symbol: DPP8
  Gene Name: dipeptidyl-peptidase 8
  ENSP ID: ENSP00000455592
MAAAMETEQLGVEIFETADCEENIESQDRPKLEPFYVERYSWSQLKKLLADTRKYHGYMMAKAPHDFMFVKRNDPDGPHSDRIYYLAMSGENRENTLFYSEIPKTINRAAVLMLSWKPLLDLFQQQPLRPNLVETSCPNIRMDPKLCPADPDWIAFIHSNDI

SEQ ID NO: 24569 - protein, 892 aa, Homo sapiens
  Payload ID: 4891
  Gene Symbol: DPP9
  Gene Name: dipeptidyl-peptidase 9
  Uniprot ID: Q86TI2
  ENSP ID: ENSP00000262960
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 24570 - protein, 67 aa, Homo sapiens
  Payload ID: 4891
  Gene Symbol: DPP9
  Gene Name: dipeptidyl-peptidase 9
  ENSP ID: ENSP00000469020
MFHFISHLRDRIFASWAISGDQSFSLNSEGAERMATTGTPTADRGDAAATDDPAARFQVQKHSWDGL

SEQ ID NO: 24571 - protein, 96 aa, Homo sapiens
  Payload ID: 4891
  Gene Symbol: DPP9
  Gene Name: dipeptidyl-peptidase 9
  ENSP ID: ENSP00000469152
MRKVKKLRLDKENTGSWRSFSLNSEGAERMATTGTPTADRGDAAATDDPAARFQVQKHSWDGLRSIIHGSRKYSGLIVNKAPHDFQFVQKTDESGP

SEQ ID NO: 24572 - protein, 220 aa, Homo sapiens
  Payload ID: 4891
  Gene Symbol: DPP9
  Gene Name: dipeptidyl-peptidase 9
  ENSP ID: ENSP00000469187
  MOD_RES (1)..(1): Any amino acid
XLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKAQPLAYPPRLPGRKRALFPHKLPRLPTDPSRETLPAPDLPQRETQYSLPRVGRAL

SEQ ID NO: 24573 - protein, 20 aa, Homo sapiens
  Payload ID: 4891
  Gene Symbol: DPP9
  Gene Name: dipeptidyl-peptidase 9
  ENSP ID: ENSP00000469282
MATTGTPTADRGDAAATDDP

SEQ ID NO: 24574 - protein, 863 aa, Homo sapiens
  Payload ID: 4891
  Gene Symbol: DPP9
  Gene Name: dipeptidyl-peptidase 9
  Uniprot ID: Q86TI2
  ENSP ID: ENSP00000469603
MATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 24575 - protein, 62 aa, Homo sapiens
  Payload ID: 4891
  Gene Symbol: DPP9
  Gene Name: dipeptidyl-peptidase 9
  ENSP ID: ENSP00000470393
MRKVKKLRLDKENTGSWRRRSLALLPRLECSGTILAPCNLHLPGSSDSSASASQVAGSTASR

SEQ ID NO: 24576 - protein, 119 aa, Homo sapiens
  Payload ID: 4891
  Gene Symbol: DPP9
  Gene Name: dipeptidyl-peptidase 9
  ENSP ID: ENSP00000471250
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSE

SEQ ID NO: 24577 - protein, 77 aa, Homo sapiens
  Payload ID: 4891
  Gene Symbol: DPP9
  Gene Name: dipeptidyl-peptidase 9
  ENSP ID: ENSP00000471629
MRKVKKLRLDKENTGSWRSFSLNSEGAERMATTGTPTADRGDAAATDDPAARFQVQKHSWDGLRSIIHGSRKYSGLI

SEQ ID NO: 24578 - protein, 151 aa, Homo sapiens
  Payload ID: 4891
  Gene Symbol: DPP9
  Gene Name: dipeptidyl-peptidase 9
  ENSP ID: ENSP00000471659
GGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTARIPRLP

SEQ ID NO: 24579 - protein, 141 aa, Homo sapiens
  Payload ID: 4891
  Gene Symbol: DPP9
  Gene Name: dipeptidyl-peptidase 9
  ENSP ID: ENSP00000471954
  MOD_RES (1)..(1): Any amino acid
XEVLARHGSKGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGP

SEQ ID NO: 24580 - protein, 836 aa, Homo sapiens
  Payload ID: 4891
  Gene Symbol: DPP9
  Gene Name: dipeptidyl-peptidase 9
  Uniprot ID: Q86TI2
  ENSP ID: ENSP00000472224
MATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQEYL

SEQ ID NO: 24581 - protein, 518 aa, Homo sapiens
  Payload ID: 4891
  Gene Symbol: DPP9
  Gene Name: dipeptidyl-peptidase 9
  ENSP ID: ENSP00000472430
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEGEQSLTNAVDSSR

SEQ ID NO: 24582 - protein, 140 aa, Homo sapiens
  Payload ID: 4891
  Gene Symbol: DPP9
  Gene Name: dipeptidyl-peptidase 9
  ENSP ID: ENSP00000472549
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDH

SEQ ID NO: 24583 - protein, 62 aa, Homo sapiens
  Payload ID: 4891
  Gene Symbol: DPP9
  Gene Name: dipeptidyl-peptidase 9
  ENSP ID: ENSP00000472968
  MOD_RES (1)..(1): Any amino acid
XEIFHFHTRSDVRLYGMIYKPHALQPGKKHPTVLFVYGGPQARPARHLVLDCWPSPPHRCSW

SEQ ID NO: 24584 - protein, 123 aa, Homo sapiens
  Payload ID: 4891
  Gene Symbol: DPP9
  Gene Name: dipeptidyl-peptidase 9
  ENSP ID: ENSP00000473130
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKK

SEQ ID NO: 24585 - protein, 68 aa, Homo sapiens
  Payload ID: 4891
  Gene Symbol: DPP9
  Gene Name: dipeptidyl-peptidase 9
  ENSP ID: ENSP00000473175
MVSPMKPLEIKTQCSGPRMDPKICPADPAFFSFINNSDLWVANIETGEERRLTFCHQGLSNVLDDPKS

SEQ ID NO: 24586 - protein, 1406 aa, Homo sapiens
  Payload ID: 4892
  Gene Symbol: PPIP5K1
  Gene Name: diphosphoinositol pentakisphosphate kinase 1
  Uniprot ID: Q6PFW1
  ENSP ID: ENSP00000308773
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGFEGCSMVPTIYPLETLHNALSLRQVSEFLSRVCQRHTDAQAQASAALFDSMHSSQASDNPFSPPRTLHSPPLQLQQRSEKPPWLETRFCHVGQAGLELLTSSDLPASASQSAGITGVSHRTQPDSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 24587 - protein, 1408 aa, Homo sapiens
  Payload ID: 4892
  Gene Symbol: PPIP5K1
  Gene Name: diphosphoinositol pentakisphosphate kinase 1
  Uniprot ID: Q6PFW1
  ENSP ID: ENSP00000334779
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 24588 - protein, 1406 aa, Homo sapiens; identical to SEQ ID NO: 24586
  Payload ID: 4892
  Gene Symbol: PPIP5K1
  Gene Name: diphosphoinositol pentakisphosphate kinase 1
  Uniprot ID: Q6PFW1
  ENSP ID: ENSP00000353253

SEQ ID NO: 24589 - protein, 1408 aa, Homo sapiens; identical to SEQ ID NO: 24587
  Payload ID: 4892
  Gene Symbol: PPIP5K1
  Gene Name: diphosphoinositol pentakisphosphate kinase 1
  Uniprot ID: Q6PFW1
  ENSP ID: ENSP00000353446

SEQ ID NO: 24590 - protein, 1409 aa, Homo sapiens
  Payload ID: 4892
  Gene Symbol: PPIP5K1
  Gene Name: diphosphoinositol pentakisphosphate kinase 1
  ENSP ID: ENSP00000371303
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 24591 - protein, 1429 aa, Homo sapiens
  Payload ID: 4892
  Gene Symbol: PPIP5K1
  Gene Name: diphosphoinositol pentakisphosphate kinase 1
  ENSP ID: ENSP00000371309
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 24592 - protein, 1433 aa, Homo sapiens
  Payload ID: 4892
  Gene Symbol: PPIP5K1
  Gene Name: diphosphoinositol pentakisphosphate kinase 1
  Uniprot ID: Q6PFW1
  ENSP ID: ENSP00000380129
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLCYLRYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 24593 - protein, 196 aa, Homo sapiens
  Payload ID: 4892
  Gene Symbol: PPIP5K1
  Gene Name: diphosphoinositol pentakisphosphate kinase 1
  ENSP ID: ENSP00000387999
  MOD_RES (1)..(1): Any amino acid
XQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLDDQHPVVRLLRSFSSDCTGGRPVSLDATLAHHLHQCSYHLRLFRNWLRSGQDDPECLYGFEGCSMVPTIYPLETLHNALSLRQVSEFLSRVC

SEQ ID NO: 24594 - protein, 114 aa, Homo sapiens
  Payload ID: 4892
  Gene Symbol: PPIP5K1
  Gene Name: diphosphoinositol pentakisphosphate kinase 1
  ENSP ID: ENSP00000390657
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSK

SEQ ID NO: 24595 - protein, 1433 aa, Homo sapiens; identical to SEQ ID NO: 24592
  Payload ID: 4892
  Gene Symbol: PPIP5K1
  Gene Name: diphosphoinositol pentakisphosphate kinase 1
  Uniprot ID: Q6PFW1
  ENSP ID: ENSP00000400887

SEQ ID NO: 24596 - protein, 114 aa, Homo sapiens; identical to SEQ ID NO: 24594
  Payload ID: 4892
  Gene Symbol: PPIP5K1
  Gene Name: diphosphoinositol pentakisphosphate kinase 1
  ENSP ID: ENSP00000405106

SEQ ID NO: 24597 - protein, 71 aa, Homo sapiens
  Payload ID: 4892
  Gene Symbol: PPIP5K1
  Gene Name: diphosphoinositol pentakisphosphate kinase 1
  ENSP ID: ENSP00000405200
MWSLTASEGESTTAHFFLGAGDEGLGTRGIGMRPEESDSELLEDEEDEVPPEPQIIVGICAMTKKSKSKPM

SEQ ID NO: 24598 - protein, 133 aa, Homo sapiens
  Payload ID: 4892
  Gene Symbol: PPIP5K1
  Gene Name: diphosphoinositol pentakisphosphate kinase 1
  ENSP ID: ENSP00000407704
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLI

SEQ ID NO: 24599 - protein, 259 aa, Homo sapiens
  Payload ID: 4892
  Gene Symbol: PPIP5K1
  Gene Name: diphosphoinositol pentakisphosphate kinase 1
  ENSP ID: ENSP00000410563
  MOD_RES (1)..(1): Any amino acid
XLPLLRKILLDLQRTHEDEYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRD

SEQ ID NO: 24600 - protein, 118 aa, Homo sapiens
  Payload ID: 4892
  Gene Symbol: PPIP5K1
  Gene Name: diphosphoinositol pentakisphosphate kinase 1
  ENSP ID: ENSP00000415349
  MOD_RES (1)..(1): Any amino acid
XPFVEKPVSAEDHNVYIYYPSSAGGGSQRLFRKIGSRSSVYSPESSVRKTGSYIYEEFMPTDGTDVKGELWAYSVMLCTCRCIQWGQIMPMLKLENLQLWMGRLNETVRGKRFDIQSC

SEQ ID NO: 24601 - protein, 1222 aa, Homo sapiens
  Payload ID: 4893
  Gene Symbol: PPIP5K2
  Gene Name: diphosphoinositol pentakisphosphate kinase 2
  Uniprot ID: O43314
  ENSP ID: ENSP00000313070
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 24602 - protein, 1243 aa, Homo sapiens
  Payload ID: 4893
  Gene Symbol: PPIP5K2
  Gene Name: diphosphoinositol pentakisphosphate kinase 2
  Uniprot ID: O43314
  ENSP ID: ENSP00000351126
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 24603 - protein, 1222 aa, Homo sapiens; identical to SEQ ID NO: 24601
  Payload ID: 4893
  Gene Symbol: PPIP5K2
  Gene Name: diphosphoinositol pentakisphosphate kinase 2
  Uniprot ID: O43314
  ENSP ID: ENSP00000416016

SEQ ID NO: 24604 - protein, 58 aa, Homo sapiens
  Payload ID: 4893
  Gene Symbol: PPIP5K2
  Gene Name: diphosphoinositol pentakisphosphate kinase 2
  ENSP ID: ENSP00000421513
MSEAPRFFVGPEDTEINPGNYRHFFHHADEDDEEEDDSPPERQIVVGICSMAKKSKSK

SEQ ID NO: 24605 - protein, 452 aa, Homo sapiens
  Payload ID: 4893
  Gene Symbol: PPIP5K2
  Gene Name: diphosphoinositol pentakisphosphate kinase 2
  ENSP ID: ENSP00000422525
MKGGNLDLNGLDHLTTARVTTAFVAGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAF

SEQ ID NO: 24606 - protein, 209 aa, Homo sapiens
  Payload ID: 4893
  Gene Symbol: PPIP5K2
  Gene Name: diphosphoinositol pentakisphosphate kinase 2
  ENSP ID: ENSP00000424535
KYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKGFLMFCNNNIFSSLKPMDSFLRVVFLNALNM

SEQ ID NO: 24607 - protein, 398 aa, Homo sapiens
  Payload ID: 4893
  Gene Symbol: PPIP5K2
  Gene Name: diphosphoinositol pentakisphosphate kinase 2
  ENSP ID: ENSP00000424948
YDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDVVSENANYLRTPRTLVEQKQNPTVGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 24608 - protein, 51 aa, Homo sapiens
  Payload ID: 4893
  Gene Symbol: PPIP5K2
  Gene Name: diphosphoinositol pentakisphosphate kinase 2
  ENSP ID: ENSP00000465165
MKGGNLDLNGLDHLTTARVTTAFVADGVLLCCPGWSTMARSPLTATSTSWI

SEQ ID NO: 24609 - protein, 255 aa, Homo sapiens
  Payload ID: 4893
  Gene Symbol: PPIP5K2
  Gene Name: diphosphoinositol pentakisphosphate kinase 2
  ENSP ID: ENSP00000467099
  MOD_RES (1)..(1): Any amino acid
XGCEEDKNLPSGYGYRPASRENEGRRPFKIDNDDEPHTSKRDEVDRAVILFKPMVSEPIHIHRKSPLPRSRKTATNDVVSENANYLRTPRTLVEQKQNPTVGSHCAGLFSTSVLGGSSSAPNLQDYARTHRKKLTSSGCIDDATRGSAVKRFSISFARHPTNGFELYSMVPSICPLETLHNALSLKQVDEFLASIASPSSDVPRKTAEISSTALRSSPIMRKKVSLNTYTPAKILPTPPATLKSTKASSKPATSG

SEQ ID NO: 24610 - protein, 58 aa, Homo sapiens
  Payload ID: 4893
  Gene Symbol: PPIP5K2
  Gene Name: diphosphoinositol pentakisphosphate kinase 2
  ENSP ID: ENSP00000467529
MQYLIQDRREVYSILQAEGILLPRYAILNRDPNNPKECNLIEGEDHVEVNGEVFQKPF

SEQ ID NO: 24611 - protein, 357 aa, Homo sapiens
  Payload ID: 4893
  Gene Symbol: PPIP5K2
  Gene Name: diphosphoinositol pentakisphosphate kinase 2
  ENSP ID: ENSP00000480381
  MOD_RES (1)..(1): Any amino acid
XLRYGALCNTNDSQNEDGGMVKEMESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKK

SEQ ID NO: 24612 - protein, 1278 aa, Homo sapiens
  Payload ID: 4893
  Gene Symbol: PPIP5K2
  Gene Name: diphosphoinositol pentakisphosphate kinase 2
  ENSP ID: ENSP00000482907
MSEAPRFFVGPEDTEINPGNYRHFFHHADEDDEEEDDSPPERQIVVGICSMAKKSKSKPMKEILERISLFKYITVVVFEEEVILNEPVENWPLCDCLISFHSKGFPLDKAVAYAKLRNPFVINDLNMQYLIQDRREVYSILQAEGILLPRYAILNRDPNNPKECNLIEGEDHVEVNGEVFQKPFVEKPVSAEDHNVYIYYPTSAGGGSQRLFRKIGSRSSVYSPESNVRKTGSYIYEEFMPTDGTDVKVYTVGPDYAHAEARKSPALDGKVERDSEGKEVRYPVILNAREKLIAWKVCLAFKQTVCGFDLLRANGQSYVCDVNGFSFVKNSMKYYDDCAKILGNIVMRELAPQFHIPWSIPLEAEDIPIVPTTSGTMMELRCVIAVIRHGDRTPKQKMKMEVRHQKFFDLFEKCDGYKSGKLKLKKPKQLQEVLDIARQLLMELGQNNDSEIEENKPKLEQLKTVLEMYGHFSGINRKVQLTYLPHGCPKTSSEEEDSRREEPSLLLVLKWGGELTPAGRVQAEELGRAFRCMYPGGQGDYAGFPGCGLLRLHSTYRHDLKIYASDEGRVQMTAAAFAKGLLALEGELTPILVQMVKSANMNGLLDSDSDSLSSCQQRVKARLHEILQKDRDFTAEDYEKLTPSGSISLIKSMHLIKNPVKTCDKVYSLIQSLTSQIRHRMEDPKSSDIQLYHSETLELMLRRWSKLEKDFKTKNGRYDISKIPDIYDCIKYDVQHNGSLKLENTMELYRLSKALADIVIPQEYGITKAEKLEIAKGYCTPLVRKIRSDLQRTQDDDTVNKLHPVYSRGVLSPERHVRTRLYFTSESHVHSLLSILRYGALCNTNDSQNEDGGMVKEMESKDEQWKRAMDYLNVVNELNYMTQIVIMLYEDPNKDLSSEERFHVELHFSPGAKGCEEDKNLPSGYGYRPASRENEGRRPFKIDNDDEPHTSKRDEVDRAVILFKPMVSEPIHIHRKSPLPRSRKTATNDEESPLSVSSPEGTGTWLHYTSGVGTGRRRRRSGEQITSSPVSPKSLAFTSSIFGSWQQVVSENANYLRTPRTLVEQKQNPTVGSHCAGLFSTSVLGGSSSAPNLQDYARTHRKKLTSSGCIDDATRGSAVKRFSISFARHPTNEHLHLYRCWSVSSVEFLGSSGFELYSMVPSICPLETLHNALSLKQVDEFLASIASPSSDVPRKTAEISSTALRSSPIMRKKVSLNTYTPAKILPTPPATLKSTKASSKPATSGPSSAVVPNTSSRKKNITSKTETHEHKKNTGKKK

SEQ ID NO: 24613 - protein, 1278 aa, Homo sapiens; identical to SEQ ID NO: 24612
  Payload ID: 4893
  Gene Symbol: PPIP5K2
  Gene Name: diphosphoinositol pentakisphosphate kinase 2
  ENSP ID: ENSP00000486357

SEQ ID NO: 24614 - protein, 443 aa, Homo sapiens
  Payload ID: 4894
  Gene Symbol: DPH1
  Gene Name: diphthamide biosynthesis 1
  Uniprot ID: Q9BZG8
  ENSP ID: ENSP00000263083
MRRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 24615 - protein, 363 aa, Homo sapiens
  Payload ID: 4894
  Gene Symbol: DPH1
  Gene Name: diphthamide biosynthesis 1
  Uniprot ID: Q9BZG8
  ENSP ID: ENSP00000458726
MPEGLLLFACTIVDILERFTEAEVMVMGDVTYGACCVDDFTARALGADFLVHYGHSCLIPMDTSAQDFRVLYVFVDIRIDTTHLLDSLRLTFPPATALALVSTIQFVSTLQAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 24616 - protein, 431 aa, Homo sapiens
  Payload ID: 4894
  Gene Symbol: DPH1
  Gene Name: diphthamide biosynthesis 1
  ENSP ID: ENSP00000458838
  MOD_RES (1)..(1): Any amino acid
XRQVMAALVVSGAAEQGGRDGPGRGRAPRGRVANQIPPEILKNPQLQAAIRVLPSNYNFEIPKTIWRIQQAQAKKVALQMPEGLLLFACTIVDILERFTEAEVMVMGDVTYGACCVDDFTARALGADFLVHYGHSCLIPMDTSAQDFRVLYVFVDIRIDTTHLLDSLRLTFPPATALALAAAQELKAEYRVSVPQCKPLSPGEILGCTSPRLSKEVEAVVYLGDGRFHLESVMIANPNVPAYRYDPYSKVLSREHYDHQRMQAARQEAIATARSAKSWGLILGTLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 24617 - protein, 214 aa, Homo sapiens
  Payload ID: 4894
  Gene Symbol: DPH1
  Gene Name: diphthamide biosynthesis 1
  ENSP ID: ENSP00000460431
  MOD_RES (1)..(1): Any amino acid
XRQVMAALVVSGAAEQGGRDGPGRGRAPRGRVANQIPPEILKNPQLQAAIRVLPSNYNFEIPKTIWRIQQAQAKKVALQMPEGLLLFACTIVDILESSHGHLGPRLPGAVRLCGHPDRHYTPPGLSPPHLSPSHCPCPGQHHSVCVDLAGSRPGAESRVSCECPTVQAPVPWRDPGLHIPPTVQRGGGRCVSWRWPLPSGVCHDCQPQCPRLPV

SEQ ID NO: 24618 - protein, 148 aa, Homo sapiens
  Payload ID: 4894
  Gene Symbol: DPH1
  Gene Name: diphthamide biosynthesis 1
  ENSP ID: ENSP00000460813
  MOD_RES (1)..(1): Any amino acid
XLGRQGSPKILEHLESRLRALGLSFVRLLLSEIFPSKLSLLPEVDVWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 24619 - protein, 49 aa, Homo sapiens
  Payload ID: 4894
  Gene Symbol: DPH1
  Gene Name: diphthamide biosynthesis 1
  ENSP ID: ENSP00000467936
TIVDILERFTEAEVMVMGDVTYGACCVDDFTARALGADFLVHYGHSCLS

SEQ ID NO: 24620 - protein, 103 aa, Homo sapiens
  Payload ID: 4894
  Gene Symbol: DPH1
  Gene Name: diphthamide biosynthesis 1
  ENSP ID: ENSP00000476070
  MOD_RES (1)..(1): Any amino acid
XWVQVACPRLSIDWGTAFPKPLLTPYEAAVALRDISWQQPYPMDFYAGSSLGPWTVNHGQDRRPHAPGRPARGKVQEGSARPPSAVACEDCSCRDEKVAPLAP

SEQ ID NO: 24621 - protein, 107 aa, Homo sapiens
  Payload ID: 4894
  Gene Symbol: DPH1
  Gene Name: diphthamide biosynthesis 1
  ENSP ID: ENSP00000476598
LRWQLLGALDGEPRPGPPSPRPGPARAGEGRRGLPGGRRDRAWALAAALRPRRETHRSGAEGNAGSQERDPNQSLRPQVQEGSARPPSAVACEDCSCRDEKVAPLAP

SEQ ID NO: 24622 - protein, 52 aa, Homo sapiens
  Payload ID: 4894
  Gene Symbol: DPH1
  Gene Name: diphthamide biosynthesis 1
  ENSP ID: ENSP00000477033
GPWTVNHGQDRRPHAPGRPARGKVQEGSARPPSAVACEDCSCRDEKVAPLAP

SEQ ID NO: 24623 - protein, 57 aa, Homo sapiens
  Payload ID: 4895
  Gene Symbol: DPH3
  Gene Name: diphthamide biosynthesis 3
  Uniprot ID: Q96FX2
  ENSP ID: ENSP00000373285
MAVFHDEVEIEDFQYDEDSETYFYPCPCGDNFSITKDQFVCGETVPAPSANKELVKC

SEQ ID NO: 24624 - protein, 82 aa, Homo sapiens
  Payload ID: 4895
  Gene Symbol: DPH3
  Gene Name: diphthamide biosynthesis 3
  Uniprot ID: Q96FX2
  ENSP ID: ENSP00000419599
MAVFHDEVEIEDFQYDEDSETYFYPCPCGDNFSITKEDLENGEDVATCPSCSLIIKVIYDKDQFVCGETVPAPSANKELVKC

SEQ ID NO: 24625 - protein, 284 aa, Homo sapiens
  Payload ID: 4896
  Gene Symbol: DPH5
  Gene Name: diphthamide biosynthesis 5
  Uniprot ID: Q9H2P9
  ENSP ID: ENSP00000339630
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPVTEETLCVGLARVGADDQKIAAGTLRQMCTVDLGEPLHSLIITGGSIHPMEMEMLSLFSIPENSSESQSINGL

SEQ ID NO: 24626 - protein, 285 aa, Homo sapiens
  Payload ID: 4896
  Gene Symbol: DPH5
  Gene Name: diphthamide biosynthesis 5
  Uniprot ID: Q9H2P9
  ENSP ID: ENSP00000359127
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 24627 - protein, 46 aa, Homo sapiens
  Payload ID: 4896
  Gene Symbol: DPH5
  Gene Name: diphthamide biosynthesis 5
  ENSP ID: ENSP00000394364
MCTVDLGEPLHSLIITGGSIHPMEMEMLSLFSIPENSSESQSINGL

SEQ ID NO: 24628 - protein, 285 aa, Homo sapiens; identical to SEQ ID NO: 24626
  Payload ID: 4896
  Gene Symbol: DPH5
  Gene Name: diphthamide biosynthesis 5
  Uniprot ID: Q9H2P9
  ENSP ID: ENSP00000418282

SEQ ID NO: 24629 - protein, 243 aa, Homo sapiens
  Payload ID: 4896
  Gene Symbol: DPH5
  Gene Name: diphthamide biosynthesis 5
  ENSP ID: ENSP00000481189
MLYLIGLGLGDAKDITVKGLEVVRRCSRVYLEAYTSVLTVGKEALEEFYGRKLVVADREEVEQEADNILKDADISDVAFLVVGDHLDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGFEHRYYHCLM

SEQ ID NO: 24630 - protein, 452 aa, Homo sapiens
  Payload ID: 4897
  Gene Symbol: DPH7
  Gene Name: diphthamide biosynthesis 7
  Uniprot ID: Q9BTV6
  ENSP ID: ENSP00000277540
MMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMEERQEATVLTSHTLPDSLVYGADWSWLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 24631 - protein, 227 aa, Homo sapiens
  Payload ID: 4897
  Gene Symbol: DPH7
  Gene Name: diphthamide biosynthesis 7
  ENSP ID: ENSP00000485026
MGQVSGRRSVPPRGLVEQVSLAFLICLLWLVGFSYDEHILLWDTRNMKQPLADTPVQGGVWRIKWHPFHHHLLLAACMHSGFKILNCQKAMEERQEATVLTSHTLPDSLVYGADWSWLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 24632 - protein, 267 aa, Homo sapiens
  Payload ID: 4898
  Gene Symbol: DPH6
  Gene Name: diphthamine biosynthesis 6
  Uniprot ID: Q7L8W6
  ENSP ID: ENSP00000256538
MRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKEKEEVEGISVGAILSDYQRIRVENVCKRLNLQPLAYLWQRNQEDLLREMISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKVSSVPDNYRTSNYIYNF

SEQ ID NO: 24633 - protein, 165 aa, Homo sapiens
  Payload ID: 4898
  Gene Symbol: DPH6
  Gene Name: diphthamine biosynthesis 6
  Uniprot ID: Q7L8W6
  ENSP ID: ENSP00000406976
MRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKGITRMTLLAEYDALNLQDFHMHLKVGSQAIVYRTPNELCTHSKFDKHTFPPFISEIAKCEV

SEQ ID NO: 24634 - protein, 169 aa, Homo sapiens
  Payload ID: 4898
  Gene Symbol: DPH6
  Gene Name: diphthamine biosynthesis 6
  ENSP ID: ENSP00000453967
MYQTVGHHAIDLYAEAMALPLYRRTIRGRSLDTRQVYTKCEGDEVEDLYELLKLVKEKEEVEGISVGAILSDYQRIRVENVCKRLNLQPLAYLWQRNQEDLLREMISSNIQAMIIKVAALGLDPDKHLGKTLDQMEPYLIELSKKYGVHVCGEGGEYETFTLDCPLFKK

SEQ ID NO: 24635 - protein, 155 aa, Homo sapiens
  Payload ID: 4898
  Gene Symbol: DPH6
  Gene Name: diphthamine biosynthesis 6
  ENSP ID: ENSP00000454015
RVENVCKRLNLQPLAYLWQRNQEDLLREMISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKCLTTTEHLIIYIIFEKCFGTLFIKPPFLY

SEQ ID NO: 24636 - protein, 198 aa, Homo sapiens
  Payload ID: 4899
  Gene Symbol: DIRAS1
  Gene Name: DIRAS family, GTP-binding RAS-like 1
  Uniprot ID: O95057
  ENSP ID: ENSP00000325836
MPEQSNDYRVVVFGAGGVGKSSLVLRFVKGTFRDTYIPTIEDTYRQVISCDKSVCTLQITDTTGSHQFPAMQRLSISKGHAFILVFSVTSKQSLEELGPIYKLIVQIKGSVEDIPVMLVGNKCDETQREVDTREAQAVAQEWKCAFMETSAKMNYNVKELFQELLTLETRRNMSLNIDGKRSGKQKRTDRVKGKCTLM

SEQ ID NO: 24637 - protein, 136 aa, Homo sapiens
  Payload ID: 4899
  Gene Symbol: DIRAS1
  Gene Name: DIRAS family, GTP-binding RAS-like 1
  ENSP ID: ENSP00000466733
MPEQSNDYRVVVFGAGGVGKSSLVLRFVKGTFRDTYIPTIEDTYRQVISCDKSVCTLQITDTTGSHQFPAMQRLSISKGHAFILVFSVTSKQSLEELGPIYKLIVQIKGSVEDIPVMLVGNKCDETQREVDTREAQ

SEQ ID NO: 24638 - protein, 198 aa, Homo sapiens; identical to SEQ ID NO: 24636
  Payload ID: 4899
  Gene Symbol: DIRAS1
  Gene Name: DIRAS family, GTP-binding RAS-like 1
  Uniprot ID: O95057
  ENSP ID: ENSP00000468417

SEQ ID NO: 24639 - protein, 199 aa, Homo sapiens
  Payload ID: 4900
  Gene Symbol: DIRAS2
  Gene Name: DIRAS family, GTP-binding RAS-like 2
  Uniprot ID: Q96HU8
  ENSP ID: ENSP00000364919
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVESIPIMLVGNKCDESPSREVQSSEAEALARTWKCAFMETSAKLNHNVKELFQELLNLEKRRTVSLQIDGKKSKQQKRKEKLKGKCVIM

SEQ ID NO: 24640 - protein, 229 aa, Homo sapiens
  Payload ID: 4901
  Gene Symbol: DIRAS3
  Gene Name: DIRAS family, GTP-binding RAS-like 3
  Uniprot ID: O95661
  ENSP ID: ENSP00000360020
MGNASFGSKEQKLLKRLRLLPALLILRAFKPHRKIRDYRVVVVGTAGVGKSTLLHKWASGNFRHEYLPTIENTYCQLLGCSHGVLSLHITDSKSGDGNRALQRHVIARGHAFVLVYSVTKKETLEELKAFYELICKIKGNNLHKFPIVLVGNKSDDTHREVALNDGATCAMEWNCAFMEISAKTDVNVQELFHMLLNYKKKPTTGLQEPEKKSQMPNTTEKLLDKCIIM

SEQ ID NO: 24641 - protein, 229 aa, Homo sapiens; identical to SEQ ID NO: 24640
  Payload ID: 4901
  Gene Symbol: DIRAS3
  Gene Name: DIRAS family, GTP-binding RAS-like 3
  Uniprot ID: O95661
  ENSP ID: ENSP00000378627

SEQ ID NO: 24642 - protein, 958 aa, Homo sapiens
  Payload ID: 4902
  Gene Symbol: DIS3
  Gene Name: DIS3 homolog, exosome endoribonuclease and 3'-5' exoribonuclease
  Uniprot ID: Q9Y2L1
  ENSP ID: ENSP00000366997
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 24643 - protein, 928 aa, Homo sapiens
  Payload ID: 4902
  Gene Symbol: DIS3
  Gene Name: DIS3 homolog, exosome endoribonuclease and 3'-5' exoribonuclease
  Uniprot ID: Q9Y2L1
  ENSP ID: ENSP00000367011
MLKSKTFLKKTRAGGVMKIVREHYLRDDIGCGAPGCAACGGAHEGPALEPQPQDPASSVCPQPHYLLPDTNVLLHQIVSAWRPGTWASVASSLRLPGSLETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 24644 - protein, 559 aa, Homo sapiens
  Payload ID: 4902
  Gene Symbol: DIS3
  Gene Name: DIS3 homolog, exosome endoribonuclease and 3'-5' exoribonuclease
  ENSP ID: ENSP00000436350
MLKSKTFLKKTRAGGVMKIVREHYLRDDIGCGAPGCAACGGAHEGPALEPQPQDPASSVCPQPHYLLPDTNVLLHQIDVLEDPAIRNVIVLQTVLQEVRNRSAPVYKRIRDVTNNQEKHFYTFTNEHHRETYVEQEQGENANDRNDRAIRVAAKWYNEHLKKMSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRHL

SEQ ID NO: 24645 - protein, 796 aa, Homo sapiens
  Payload ID: 4902
  Gene Symbol: DIS3
  Gene Name: DIS3 homolog, exosome endoribonuclease and 3'-5' exoribonuclease
  ENSP ID: ENSP00000440058
MSADNQLQVIFITNDRRNKEKAIEEGIPAFTCEEYVKSLTANPELIDRLACLSEEGNEIESGKIIFSEHLPLSKLQQGIKSGTYLQGTFRASRENYLEATVWIHGDNEENKEIILQGLKHLNRAVHEDIVAVELLPKSQWVAPSSVVLHDEGQNEEDVEKEEETERMLKTAVSEKMLKPTGRVVGIIKRNWRPYCGMLSKSDIKESRRHLFTPADKRIPRIRIETRQASTLEGRRIIVAIDGWPRNSRYPNGHFVRNLGDVGEKETETEVLLLEHDVPHQPFSQAVLSFLPKMPWSITEKDMKNREDLRHLCICSVDPPGCTDIDDALHCRELENGNLEVGVHIADVSHFIRPGNALDQESARRGTTVYLCEKRIDMVPELLSSNLCSLKCDVDRLAFSCIWEMNHNAEILKTKFTKSVINSKASLTYAEAQLRIDSANMNDDITTSLRGLNKLAKILKKRRIEKGALTLSSPEVRFHMDSETHDPIDLQTKELRETNSMVEEFMLLANISVAKKIHEEFSEHALLRKHPAPPPSNYEILVKAARSRNLEIKTDTAKSLAESLDQAESPTFPYLNTLLRILATRCMMQAVYFCSGMDNDFHHYGLASPIYTHFTSPIRRYADVIVHRLLAVAIGADCTYPELTDKHKLADICKNLNFRHKMAQYAQRASVAFHTQLFFKSKGIVSEEAYILFVRKNAIVVLIPKYGLEGTVFFEEKDKPNPQLIYDDEIPSLKIEDTVFHVFDKVKVKIMLDSSNLQHQKIRMSLVEPQIPGISIPTDTSNMDLNGPKKKKMKLGK

SEQ ID NO: 24646 - protein, 603 aa, Homo sapiens
  Payload ID: 4903
  Gene Symbol: DIS3L2
  Gene Name: DIS3 like 3'-5' exoribonuclease 2
  Uniprot ID: Q8IYB7
  ENSP ID: ENSP00000273009
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQQNADKDGAAHLQASHSPSAEDAEAQPSTEERLPETRGICDRDPDTRLFFLQQQSRVLEAKPQNTIRVEEQTTQLQI

SEQ ID NO: 24647 - protein, 885 aa, Homo sapiens
  Payload ID: 4903
  Gene Symbol: DIS3L2
  Gene Name: DIS3 like 3'-5' exoribonuclease 2
  Uniprot ID: Q8IYB7
  ENSP ID: ENSP00000315569
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQVITIFSLVEVVLQAESTALKYSAILKRPGTQGHLGPEKEEEESDGEPEDSSTS

SEQ ID NO: 24648 - protein, 619 aa, Homo sapiens
  Payload ID: 4903
  Gene Symbol: DIS3L2
  Gene Name: DIS3 like 3'-5' exoribonuclease 2
  Uniprot ID: Q8IYB7
  ENSP ID: ENSP00000374655
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKPCCAGTPRPKQGCSVTWWNSATRWGCPWTSAPQEPSIKA

SEQ ID NO: 24649 - protein, 249 aa, Homo sapiens
  Payload ID: 4903
  Gene Symbol: DIS3L2
  Gene Name: DIS3 like 3'-5' exoribonuclease 2
  Uniprot ID: Q8IYB7
  ENSP ID: ENSP00000386594
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVIAYRFSPRVQMAFT

SEQ ID NO: 24650 - protein, 885 aa, Homo sapiens; identical to SEQ ID NO: 24647
  Payload ID: 4903
  Gene Symbol: DIS3L2
  Gene Name: DIS3 like 3'-5' exoribonuclease 2
  Uniprot ID: Q8IYB7
  ENSP ID: ENSP00000386799

SEQ ID NO: 24651 - protein, 249 aa, Homo sapiens; identical to SEQ ID NO: 24649
  Payload ID: 4903
  Gene Symbol: DIS3L2
  Gene Name: DIS3 like 3'-5' exoribonuclease 2
  Uniprot ID: Q8IYB7
  ENSP ID: ENSP00000388999

SEQ ID NO: 24652 - protein, 144 aa, Homo sapiens
  Payload ID: 4903
  Gene Symbol: DIS3L2
  Gene Name: DIS3 like 3'-5' exoribonuclease 2
  ENSP ID: ENSP00000390467
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEE

SEQ ID NO: 24653 - protein, 356 aa, Homo sapiens
  Payload ID: 4903
  Gene Symbol: DIS3L2
  Gene Name: DIS3 like 3'-5' exoribonuclease 2
  Uniprot ID: Q8IYB7
  ENSP ID: ENSP00000391175
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKDNEIEAQRSSWAYPVSHRKSEERMVMHRLQKMRPPAFHKTQELYRRNPCKDQQRWFTSWRKNILEQQPASSNSWLIRTANCLGNTPCFLPQTTECLEFMCLSRTVPRTLWHGLKIMPTHCSSAALWTGRRTAILPWGSWLRVLGRLVKLSLKQKEY

SEQ ID NO: 24654 - protein, 196 aa, Homo sapiens
  Payload ID: 4903
  Gene Symbol: DIS3L2
  Gene Name: DIS3 like 3'-5' exoribonuclease 2
  ENSP ID: ENSP00000392754
  MOD_RES (1)..(1): Any amino acid
XFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQETKNPTSEIPQLGDPARPPSRASQSASPLVCSELPVTLLMPIRAQPGIALRGGKLHETKNKLRGEHRP

SEQ ID NO: 24655 - protein, 166 aa, Homo sapiens
  Payload ID: 4903
  Gene Symbol: DIS3L2
  Gene Name: DIS3 like 3'-5' exoribonuclease 2
  ENSP ID: ENSP00000401700
  MOD_RES (1)..(1): Any amino acid
XVMGILKQAFDVLVLRYGVQKRIYCNALALRSHHFQKVGKKPELTLVWEPEDMEQEPAQQGILPGGGPHYRQASRGFQRPKEGPGVLLQGWRQSCASTSGPAILVPSRLGSAQVITIFSLVEVVLQAESTALKYSAILKRPGTQGHLGPEKEEEESDGEPEDSSTS

SEQ ID NO: 24656 - protein, 68 aa, Homo sapiens
  Payload ID: 4903
  Gene Symbol: DIS3L2
  Gene Name: DIS3 like 3'-5' exoribonuclease 2
  ENSP ID: ENSP00000408764
RSHHFQKVGKKPELTLVWEPEDMEQEPAQQGPLENLMKAMSLHPRNCLEPFSPTVCPERGPRPSGCVS

SEQ ID NO: 24657 - protein, 383 aa, Homo sapiens
  Payload ID: 4903
  Gene Symbol: DIS3L2
  Gene Name: DIS3 like 3'-5' exoribonuclease 2
  ENSP ID: ENSP00000415419
EEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKR

SEQ ID NO: 24658 - protein, 971 aa, Homo sapiens
  Payload ID: 4904
  Gene Symbol: DIS3L
  Gene Name: DIS3 like exosome 3'-5' exoribonuclease
  Uniprot ID: Q8TF46
  ENSP ID: ENSP00000321583
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLDEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 24659 - protein, 1054 aa, Homo sapiens
  Payload ID: 4904
  Gene Symbol: DIS3L
  Gene Name: DIS3 like exosome 3'-5' exoribonuclease
  Uniprot ID: Q8TF46
  ENSP ID: ENSP00000321711
MLQKREKVLLLRTFQGRTLRIVREHYLRPCVPCHSPLCPQPAACSHDGKLLSSDVTHYVIPDWKVVQDYLEILEFPELKGIIFMQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKARNRSIHGDVVVVELLPKNEWKGRTVALCENDCDDKASGESPSEPMPTGRVVGILQKNWRDYVVTFPSKEEVQSQGKNAQKILVTPWDYRIPKIRISTQQAETLQDFRVVVRIDSWESTSVYPNGHFVRVLGRIGDLEGEIATILVENSISVIPFSEAQMCEMPVNTPESPWKVSPEEEQKRKDLRKSHLVFSIDPKGCEDVDDTLSVRTLNNGNLELGVHIADVTHFVAPNSYIDIEARTRATTYYLADRRYDMLPSVLSADLCSLLGGVDRYAVSIMWELDKASYEIKKVWYGRTIIRSAYKLFYEAAQELLDGNLSVVDDIPEFKDLDEKSRQAKLEELVWAIGKLTDIARHVRAKRDGCGALELEGVEVCVQLDDKKNIHDLIPKQPLEVHETVAECMILANHWVAKKIWESFPHQALLRQHPPPHQEFFSELRECAKAKGFFIDTRSNKTLADSLDNANDPHDPIVNRLLRSMATQAMSNALYFSTGSCAEEEFHHYGLALDKYTHFTSPIRRYSDIVVHRLLMAAISKDKKMEIKGNLFSNKDLEELCRHINNRNQAAQHSQKQSTELFQCMYFKDKDPATEERCISDGVIYSIRTNGVLLFIPRFGIKGAAYLKNKDGLVISCGPDSCSEWKPGSLQRFQNKITSTTTDGESVTFHLFDHVTVRISIQASRCHSDTIRLEIISNKPYKIPNTELIHQSSPLLKSELVKEVTKSVEEAQLAQEVKVNIIQEEYQEYRQTKGRSLYTLLEEIRDLALLDVSNNYGI

SEQ ID NO: 24660 - protein, 150 aa, Homo sapiens
  Payload ID: 4904
  Gene Symbol: DIS3L
  Gene Name: DIS3 like exosome 3'-5' exoribonuclease
  ENSP ID: ENSP00000432125
MEKWQTRSIYNAAVWYYHHCQDRMPIVMVTEDEEAIQQYGSETEGVFVITFKNYLDNFWPDLKAAHELCDSILQSRRERENESQESHGKEYPEHLPLEVLEAGIKSGRYIQGILNVNKHRAQIEAFVRLQGASSKDSDLVSDILIHGMKA

SEQ ID NO: 24661 - protein, 55 aa, Homo sapiens
  Payload ID: 4904
  Gene Symbol: DIS3L
  Gene Name: DIS3 like exosome 3'-5' exoribonuclease
  ENSP ID: ENSP00000432407
MQTACQAVQHQRGRSNAAICHGKEESPWRSGRPGAYTTQLFGTIITARTGCQLLW

SEQ ID NO: 24662 - protein, 55 aa, Homo sapiens; identical to SEQ ID NO: 24661
  Payload ID: 4904
  Gene Symbol: DIS3L
  Gene Name: DIS3 like exosome 3'-5' exoribonuclease
  ENSP ID: ENSP00000433504

SEQ ID NO: 24663 - protein, 57 aa, Homo sapiens
  Payload ID: 4904
  Gene Symbol: DIS3L
  Gene Name: DIS3 like exosome 3'-5' exoribonuclease
  ENSP ID: ENSP00000435792
MQTACQAVQHQRGRRQYNKLRNLLKDARHDCILFANEFQQCCYLPRERGESMEKWQT

SEQ ID NO: 24664 - protein, 97 aa, Homo sapiens
  Payload ID: 4904
  Gene Symbol: DIS3L
  Gene Name: DIS3 like exosome 3'-5' exoribonuclease
  ENSP ID: ENSP00000436573
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGV

SEQ ID NO: 24665 - protein, 103 aa, Homo sapiens
  Payload ID: 4904
  Gene Symbol: DIS3L
  Gene Name: DIS3 like exosome 3'-5' exoribonuclease
  ENSP ID: ENSP00000436583
MQTACQAVQHQRGRRQYNKLRNLLKDARHDCILFANEFQQCCYLPRERGESMEKWQTRSIYNAAVWYYHHCQDRMPIVMVTEDEEAIQQYGSETEGVFVITFK

SEQ ID NO: 24666 - protein, 876 aa, Homo sapiens
  Payload ID: 4905
  Gene Symbol: DDR1
  Gene Name: discoidin domain receptor tyrosine kinase 1
  Uniprot ID: Q08345
  ENSP ID: ENSP00000259875
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24667 - protein, 913 aa, Homo sapiens
  Payload ID: 4905
  Gene Symbol: DDR1
  Gene Name: discoidin domain receptor tyrosine kinase 1
  Uniprot ID: Q08345
  ENSP ID: ENSP00000318217
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24668 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000365751

SEQ ID NO: 24669 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000365752

SEQ ID NO: 24670 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000365753

SEQ ID NO: 24671 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000365754

SEQ ID NO: 24672 - protein, 243 aa, Homo sapiens
  Payload ID: 4905
  Gene Symbol: DDR1
  Gene Name: discoidin domain receptor tyrosine kinase 1
  Uniprot ID: Q08345
  ENSP ID: ENSP00000365759
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDCSMGVWASWQMVWWGWMTLGRVRSCGSGQAMTMWDGATTASPVAMWRWSLSLTG

SEQ ID NO: 24673 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000372868

SEQ ID NO: 24674 - protein, 147 aa, Homo sapiens
  Payload ID: 4905
  Gene Symbol: DDR1
  Gene Name: discoidin domain receptor tyrosine kinase 1
  ENSP ID: ENSP00000379631
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDP

SEQ ID NO: 24675 - protein, 147 aa, Homo sapiens; identical to SEQ ID NO: 24674
  Payload ID: 4905
  Gene Symbol: DDR1
  Gene Name: discoidin domain receptor tyrosine kinase 1
  ENSP ID: ENSP00000383258

SEQ ID NO: 24676 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000383261

SEQ ID NO: 24677 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000383262

SEQ ID NO: 24678 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000383265

SEQ ID NO: 24679 - protein, 147 aa, Homo sapiens; identical to SEQ ID NO: 24674
  Payload ID: 4905
  Gene Symbol: DDR1
  Gene Name: discoidin domain receptor tyrosine kinase 1
  ENSP ID: ENSP00000383332

SEQ ID NO: 24680 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000383334

SEQ ID NO: 24681 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000383336

SEQ ID NO: 24682 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000383337

SEQ ID NO: 24683 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000383338

SEQ ID NO: 24684 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000383339

SEQ ID NO: 24685 - protein, 139 aa, Homo sapiens
  Payload ID: 4905
  Gene Symbol: DDR1
  Gene Name: discoidin domain receptor tyrosine kinase 1
  ENSP ID: ENSP00000388866
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQE

SEQ ID NO: 24686 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000389085

SEQ ID NO: 24687 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000390043

SEQ ID NO: 24688 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000390361

SEQ ID NO: 24689 - protein, 267 aa, Homo sapiens
  Payload ID: 4905
  Gene Symbol: DDR1
  Gene Name: discoidin domain receptor tyrosine kinase 1
  ENSP ID: ENSP00000390593
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGY

SEQ ID NO: 24690 - protein, 493 aa, Homo sapiens
  Payload ID: 4905
  Gene Symbol: DDR1
  Gene Name: discoidin domain receptor tyrosine kinase 1
  ENSP ID: ENSP00000391243
SEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLN

SEQ ID NO: 24691 - protein, 63 aa, Homo sapiens
  Payload ID: 4905
  Gene Symbol: DDR1
  Gene Name: discoidin domain receptor tyrosine kinase 1
  ENSP ID: ENSP00000391297
MGPEALSSLLLLLLVASGDADMKGHFDPAKCRYALGMQDRTIPDSDISASSSWSDSTAARHSR

SEQ ID NO: 24692 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000391805

SEQ ID NO: 24693 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000391895

SEQ ID NO: 24694 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000392200

SEQ ID NO: 24695 - protein, 58 aa, Homo sapiens
  Payload ID: 4905
  Gene Symbol: DDR1
  Gene Name: discoidin domain receptor tyrosine kinase 1
  ENSP ID: ENSP00000392413
MGPEALSSLLLLLLVASGDADMKGHFDPAKCRYALGMQDRTIPDSDISASSSWSDSTA

SEQ ID NO: 24696 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000392422

SEQ ID NO: 24697 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000393056

SEQ ID NO: 24698 - protein, 493 aa, Homo sapiens
  Payload ID: 4905
  Gene Symbol: DDR1
  Gene Name: discoidin domain receptor tyrosine kinase 1
  ENSP ID: ENSP00000394161
SEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTLLPVSPMALRCCSPIQPTASFWPLTPVPLEARAPPHPPGPNPPTPRGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLN

SEQ ID NO: 24699 - protein, 153 aa, Homo sapiens
  Payload ID: 4905
  Gene Symbol: DDR1
  Gene Name: discoidin domain receptor tyrosine kinase 1
  ENSP ID: ENSP00000394273
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLK

SEQ ID NO: 24700 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000395136

SEQ ID NO: 24701 - protein, 250 aa, Homo sapiens
  Payload ID: 4905
  Gene Symbol: DDR1
  Gene Name: discoidin domain receptor tyrosine kinase 1
  ENSP ID: ENSP00000395405
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVW

SEQ ID NO: 24702 - protein, 378 aa, Homo sapiens
  Payload ID: 4905
  Gene Symbol: DDR1
  Gene Name: discoidin domain receptor tyrosine kinase 1
  ENSP ID: ENSP00000396139
  MOD_RES (1)..(1): Any amino acid
XYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24703 - protein, 250 aa, Homo sapiens; identical to SEQ ID NO: 24701
  Payload ID: 4905
  Gene Symbol: DDR1
  Gene Name: discoidin domain receptor tyrosine kinase 1
  ENSP ID: ENSP00000396187

SEQ ID NO: 24704 - protein, 166 aa, Homo sapiens
  Payload ID: 4905
  Gene Symbol: DDR1
  Gene Name: discoidin domain receptor tyrosine kinase 1
  ENSP ID: ENSP00000396609
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRF

SEQ ID NO: 24705 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000397769

SEQ ID NO: 24706 - protein, 63 aa, Homo sapiens; identical to SEQ ID NO: 24691
  Payload ID: 4905
  Gene Symbol: DDR1
  Gene Name: discoidin domain receptor tyrosine kinase 1
  ENSP ID: ENSP00000397897

SEQ ID NO: 24707 - protein, 378 aa, Homo sapiens; identical to SEQ ID NO: 24702
  Payload ID: 4905
  Gene Symbol: DDR1
  Gene Name: discoidin domain receptor tyrosine kinase 1
  ENSP ID: ENSP00000398339
  MOD_RES (1)..(1): Any amino acid

SEQ ID NO: 24708 - protein, 63 aa, Homo sapiens; identical to SEQ ID NO: 24691
  Payload ID: 4905
  Gene Symbol: DDR1
  Gene Name: discoidin domain receptor tyrosine kinase 1
  ENSP ID: ENSP00000398343

SEQ ID NO: 24709 - protein, 493 aa, Homo sapiens; identical to SEQ ID NO: 24690
  Payload ID: 4905
  Gene Symbol: DDR1
  Gene Name: discoidin domain receptor tyrosine kinase 1
  ENSP ID: ENSP00000398682

SEQ ID NO: 24710 - protein, 250 aa, Homo sapiens; identical to SEQ ID NO: 24701
  Payload ID: 4905
  Gene Symbol: DDR1
  Gene Name: discoidin domain receptor tyrosine kinase 1
  ENSP ID: ENSP00000398904

SEQ ID NO: 24711 - protein, 147 aa, Homo sapiens; identical to SEQ ID NO: 24674
  Payload ID: 4905
  Gene Symbol: DDR1
  Gene Name: discoidin domain receptor tyrosine kinase 1
  ENSP ID: ENSP00000399276

SEQ ID NO: 24712 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000400393

SEQ ID NO: 24713 - protein, 209 aa, Homo sapiens
  Payload ID: 4905
  Gene Symbol: DDR1
  Gene Name: discoidin domain receptor tyrosine kinase 1
  ENSP ID: ENSP00000400536
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVY

SEQ ID NO: 24714 - protein, 166 aa, Homo sapiens; identical to SEQ ID NO: 24704
  Payload ID: 4905
  Gene Symbol: DDR1
  Gene Name: discoidin domain receptor tyrosine kinase 1
  ENSP ID: ENSP00000400697

SEQ ID NO: 24715 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000401208

SEQ ID NO: 24716 - protein, 250 aa, Homo sapiens; identical to SEQ ID NO: 24701
  Payload ID: 4905
  Gene Symbol: DDR1
  Gene Name: discoidin domain receptor tyrosine kinase 1
  ENSP ID: ENSP00000401304

SEQ ID NO: 24717 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000401397

SEQ ID NO: 24718 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000402013

SEQ ID NO: 24719 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000402647

SEQ ID NO: 24720 - protein, 147 aa, Homo sapiens; identical to SEQ ID NO: 24674
  Payload ID: 4905
  Gene Symbol: DDR1
  Gene Name: discoidin domain receptor tyrosine kinase 1
  ENSP ID: ENSP00000402765

SEQ ID NO: 24721 - protein, 209 aa, Homo sapiens; identical to SEQ ID NO: 24713
  Payload ID: 4905
  Gene Symbol: DDR1
  Gene Name: discoidin domain receptor tyrosine kinase 1
  ENSP ID: ENSP00000402992

SEQ ID NO: 24722 - protein, 493 aa, Homo sapiens; identical to SEQ ID NO: 24690
  Payload ID: 4905
  Gene Symbol: DDR1
  Gene Name: discoidin domain receptor tyrosine kinase 1
  ENSP ID: ENSP00000403247

SEQ ID NO: 24723 - protein, 250 aa, Homo sapiens; identical to SEQ ID NO: 24701
  Payload ID: 4905
  Gene Symbol: DDR1
  Gene Name: discoidin domain receptor tyrosine kinase 1
  ENSP ID: ENSP00000403454

SEQ ID NO: 24724 - protein, 209 aa, Homo sapiens; identical to SEQ ID NO: 24713
  Payload ID: 4905
  Gene Symbol: DDR1
  Gene Name: discoidin domain receptor tyrosine kinase 1
  ENSP ID: ENSP00000404001

SEQ ID NO: 24725 - protein, 63 aa, Homo sapiens; identical to SEQ ID NO: 24691
  Payload ID: 4905
  Gene Symbol: DDR1
  Gene Name: discoidin domain receptor tyrosine kinase 1
  ENSP ID: ENSP00000404054

SEQ ID NO: 24726 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000405039

SEQ ID NO: 24727 - protein, 493 aa, Homo sapiens; identical to SEQ ID NO: 24690
  Payload ID: 4905
  Gene Symbol: DDR1
  Gene Name: discoidin domain receptor tyrosine kinase 1
  ENSP ID: ENSP00000405419

SEQ ID NO: 24728 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000405540

SEQ ID NO: 24729 - protein, 378 aa, Homo sapiens; identical to SEQ ID NO: 24702
  Payload ID: 4905
  Gene Symbol: DDR1
  Gene Name: discoidin domain receptor tyrosine kinase 1
  ENSP ID: ENSP00000405579
  MOD_RES (1)..(1): Any amino acid

SEQ ID NO: 24730 - protein, 767 aa, Homo sapiens
  Payload ID: 4905
  Gene Symbol: DDR1
  Gene Name: discoidin domain receptor tyrosine kinase 1
  ENSP ID: ENSP00000405998
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTPLPVSPMALVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24731 - protein, 63 aa, Homo sapiens; identical to SEQ ID NO: 24691
  Payload ID: 4905
  Gene Symbol: DDR1
  Gene Name: discoidin domain receptor tyrosine kinase 1
  ENSP ID: ENSP00000406089

SEQ ID NO: 24732 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000406091

SEQ ID NO: 24733 - protein, 63 aa, Homo sapiens; identical to SEQ ID NO: 24691
  Payload ID: 4905
  Gene Symbol: DDR1
  Gene Name: discoidin domain receptor tyrosine kinase 1
  ENSP ID: ENSP00000406200

SEQ ID NO: 24734 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000406688

SEQ ID NO: 24735 - protein, 147 aa, Homo sapiens; identical to SEQ ID NO: 24674
  Payload ID: 4905
  Gene Symbol: DDR1
  Gene Name: discoidin domain receptor tyrosine kinase 1
  ENSP ID: ENSP00000406865

SEQ ID NO: 24736 - protein, 166 aa, Homo sapiens; identical to SEQ ID NO: 24704
  Payload ID: 4905
  Gene Symbol: DDR1
  Gene Name: discoidin domain receptor tyrosine kinase 1
  ENSP ID: ENSP00000407068

SEQ ID NO: 24737 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000407699

SEQ ID NO: 24738 - protein, 378 aa, Homo sapiens; identical to SEQ ID NO: 24702
  Payload ID: 4905
  Gene Symbol: DDR1
  Gene Name: discoidin domain receptor tyrosine kinase 1
  ENSP ID: ENSP00000408328
  MOD_RES (1)..(1): Any amino acid

SEQ ID NO: 24739 - protein, 166 aa, Homo sapiens; identical to SEQ ID NO: 24704
  Payload ID: 4905
  Gene Symbol: DDR1
  Gene Name: discoidin domain receptor tyrosine kinase 1
  ENSP ID: ENSP00000408790

SEQ ID NO: 24740 - protein, 196 aa, Homo sapiens
  Payload ID: 4905
  Gene Symbol: DDR1
  Gene Name: discoidin domain receptor tyrosine kinase 1
  ENSP ID: ENSP00000409400
  MOD_RES (1)..(1): Any amino acid
XSLLLLLLVASGDADMKGHFDPAKCRYALGMQDRTIPDSDISASSSWLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLND

SEQ ID NO: 24741 - protein, 209 aa, Homo sapiens; identical to SEQ ID NO: 24713
  Payload ID: 4905
  Gene Symbol: DDR1
  Gene Name: discoidin domain receptor tyrosine kinase 1
  ENSP ID: ENSP00000409682

SEQ ID NO: 24742 - protein, 46 aa, Homo sapiens
  Payload ID: 4905
  Gene Symbol: DDR1
  Gene Name: discoidin domain receptor tyrosine kinase 1
  ENSP ID: ENSP00000412396
SEAVYLNDSTYDGHTVGGLQYGGLGQLADGVVGLDDFRKSQELRVW

SEQ ID NO: 24743 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000414285

SEQ ID NO: 24744 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000414878

SEQ ID NO: 24745 - protein, 139 aa, Homo sapiens; identical to SEQ ID NO: 24685
  Payload ID: 4905
  Gene Symbol: DDR1
  Gene Name: discoidin domain receptor tyrosine kinase 1
  ENSP ID: ENSP00000414928

SEQ ID NO: 24746 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000415730

SEQ ID NO: 24747 - protein, 209 aa, Homo sapiens; identical to SEQ ID NO: 24713
  Payload ID: 4905
  Gene Symbol: DDR1
  Gene Name: discoidin domain receptor tyrosine kinase 1
  ENSP ID: ENSP00000415865

SEQ ID NO: 24748 - protein, 209 aa, Homo sapiens; identical to SEQ ID NO: 24713
  Payload ID: 4905
  Gene Symbol: DDR1
  Gene Name: discoidin domain receptor tyrosine kinase 1
  ENSP ID: ENSP00000415870

SEQ ID NO: 24749 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000416145

SEQ ID NO: 24750 - protein, 876 aa, Homo sapiens; identical to SEQ ID NO: 24666
  Payload ID: 4905
  Gene Symbol: DDR1
  Gene Name: discoidin domain receptor tyrosine kinase 1
  Uniprot ID: Q08345
  ENSP ID: ENSP00000416183

SEQ ID NO: 24751 - protein, 100 aa, Homo sapiens
  Payload ID: 4905
  Gene Symbol: DDR1
  Gene Name: discoidin domain receptor tyrosine kinase 1
  ENSP ID: ENSP00000420833
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALV

SEQ ID NO: 24752 - protein, 69 aa, Homo sapiens
  Payload ID: 4905
  Gene Symbol: DDR1
  Gene Name: discoidin domain receptor tyrosine kinase 1
  ENSP ID: ENSP00000421152
MVARLVRFYPRADRVMSVCLRVELYGCLWRDGLLSYTAPVGQTMYLSEAVYLNDSTYDGHTVGGLQYGG

SEQ ID NO: 24753 - protein, 132 aa, Homo sapiens
  Payload ID: 4905
  Gene Symbol: DDR1
  Gene Name: discoidin domain receptor tyrosine kinase 1
  ENSP ID: ENSP00000421189
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGW

SEQ ID NO: 24754 - protein, 112 aa, Homo sapiens
  Payload ID: 4905
  Gene Symbol: DDR1
  Gene Name: discoidin domain receptor tyrosine kinase 1
  ENSP ID: ENSP00000421719
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGK

SEQ ID NO: 24755 - protein, 35 aa, Homo sapiens
  Payload ID: 4905
  Gene Symbol: DDR1
  Gene Name: discoidin domain receptor tyrosine kinase 1
  ENSP ID: ENSP00000421753
MGPEALSSLLLLLLVASGDADMKGHFDPGPDHPRQ

SEQ ID NO: 24756 - protein, 243 aa, Homo sapiens; identical to SEQ ID NO: 24672
  Payload ID: 4905
  Gene Symbol: DDR1
  Gene Name: discoidin domain receptor tyrosine kinase 1
  Uniprot ID: Q08345
  ENSP ID: ENSP00000421978

SEQ ID NO: 24757 - protein, 138 aa, Homo sapiens
  Payload ID: 4905
  Gene Symbol: DDR1
  Gene Name: discoidin domain receptor tyrosine kinase 1
  ENSP ID: ENSP00000422108
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQ

SEQ ID NO: 24758 - protein, 114 aa, Homo sapiens
  Payload ID: 4905
  Gene Symbol: DDR1
  Gene Name: discoidin domain receptor tyrosine kinase 1
  ENSP ID: ENSP00000422331
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEF

SEQ ID NO: 24759 - protein, 894 aa, Homo sapiens
  Payload ID: 4905
  Gene Symbol: DDR1
  Gene Name: discoidin domain receptor tyrosine kinase 1
  Uniprot ID: Q08345
  ENSP ID: ENSP00000422442
MSLPRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24760 - protein, 138 aa, Homo sapiens; identical to SEQ ID NO: 24757
  Payload ID: 4905
  Gene Symbol: DDR1
  Gene Name: discoidin domain receptor tyrosine kinase 1
  ENSP ID: ENSP00000422467

SEQ ID NO: 24761 - protein, 41 aa, Homo sapiens
  Payload ID: 4905
  Gene Symbol: DDR1
  Gene Name: discoidin domain receptor tyrosine kinase 1
  ENSP ID: ENSP00000422974
MGPEALSSLLLLLLVASGDADMKGHFDPAKCRYALGMQDRT

SEQ ID NO: 24762 - protein, 85 aa, Homo sapiens
  Payload ID: 4905
  Gene Symbol: DDR1
  Gene Name: discoidin domain receptor tyrosine kinase 1
  ENSP ID: ENSP00000423492
MGPEALSSLLLLLLVASGDADMKGHFDPAKCRYALGMQDRTIPDSDISASSSWSDSTAARHSRLESSDGDGAWCPAGSVFPKEEE

SEQ ID NO: 24763 - protein, 196 aa, Homo sapiens
  Payload ID: 4905
  Gene Symbol: DDR1
  Gene Name: discoidin domain receptor tyrosine kinase 1
  ENSP ID: ENSP00000423749
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 24764 - protein, 122 aa, Homo sapiens
  Payload ID: 4905
  Gene Symbol: DDR1
  Gene Name: discoidin domain receptor tyrosine kinase 1
  ENSP ID: ENSP00000423906
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRY

SEQ ID NO: 24765 - protein, 51 aa, Homo sapiens
  Payload ID: 4905
  Gene Symbol: DDR1
  Gene Name: discoidin domain receptor tyrosine kinase 1
  ENSP ID: ENSP00000423928
MGPEALSSLLLLLLVASGDADMKGHFDPAKCRYALGMQDRTIPDSDISASS

SEQ ID NO: 24766 - protein, 277 aa, Homo sapiens
  Payload ID: 4905
  Gene Symbol: DDR1
  Gene Name: discoidin domain receptor tyrosine kinase 1
  ENSP ID: ENSP00000424003
  MOD_RES (1)..(1): Any amino acid
XRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVRVEEREDGSEAGDRRGRVVILETKEYLFPDSHPHCHNAGVPVPAACLPAGPI

SEQ ID NO: 24767 - protein, 55 aa, Homo sapiens
  Payload ID: 4905
  Gene Symbol: DDR1
  Gene Name: discoidin domain receptor tyrosine kinase 1
  ENSP ID: ENSP00000424346
MGPEALSSLLLLLLVASGDADMKGHFDPAKCRYALGMQDRTIPDSDISASSSWSD

SEQ ID NO: 24768 - protein, 51 aa, Homo sapiens; identical to SEQ ID NO: 24765
  Payload ID: 4905
  Gene Symbol: DDR1
  Gene Name: discoidin domain receptor tyrosine kinase 1
  ENSP ID: ENSP00000424468

SEQ ID NO: 24769 - protein, 78 aa, Homo sapiens
  Payload ID: 4905
  Gene Symbol: DDR1
  Gene Name: discoidin domain receptor tyrosine kinase 1
  ENSP ID: ENSP00000424703
MGPEALSSLLLLLLVASGDADMKGHFDPAKCRYALGMQDRTIPDSDISASSSWSDSTAARHSRLESSDGDGAWCPAGS

SEQ ID NO: 24770 - protein, 73 aa, Homo sapiens
  Payload ID: 4905
  Gene Symbol: DDR1
  Gene Name: discoidin domain receptor tyrosine kinase 1
  ENSP ID: ENSP00000424758
MGPEALSSLLLLLLVASGDADMKGHFDPAKCRYALGMQDRTIPDSDISASSSWSDSTAARHSRLESSDGDGAW

SEQ ID NO: 24771 - protein, 142 aa, Homo sapiens
  Payload ID: 4905
  Gene Symbol: DDR1
  Gene Name: discoidin domain receptor tyrosine kinase 1
  ENSP ID: ENSP00000425113
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVIS

SEQ ID NO: 24772 - protein, 70 aa, Homo sapiens
  Payload ID: 4905
  Gene Symbol: DDR1
  Gene Name: discoidin domain receptor tyrosine kinase 1
  ENSP ID: ENSP00000425713
MGPEALSSLLLLLLVASGDADMKGHFDPAKCRYALGMQDRTIPDSDISASSSWSDSTAARHSRLESSDGD

SEQ ID NO: 24773 - protein, 170 aa, Homo sapiens
  Payload ID: 4905
  Gene Symbol: DDR1
  Gene Name: discoidin domain receptor tyrosine kinase 1
  ENSP ID: ENSP00000426229
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRA

SEQ ID NO: 24774 - protein, 286 aa, Homo sapiens
  Payload ID: 4905
  Gene Symbol: DDR1
  Gene Name: discoidin domain receptor tyrosine kinase 1
  ENSP ID: ENSP00000426420
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVH

SEQ ID NO: 24775 - protein, 35 aa, Homo sapiens; identical to SEQ ID NO: 24755
  Payload ID: 4905
  Gene Symbol: DDR1
  Gene Name: discoidin domain receptor tyrosine kinase 1
  ENSP ID: ENSP00000426799

SEQ ID NO: 24776 - protein, 172 aa, Homo sapiens
  Payload ID: 4905
  Gene Symbol: DDR1
  Gene Name: discoidin domain receptor tyrosine kinase 1
  ENSP ID: ENSP00000427124
  MOD_RES (1)..(1): Any amino acid
XNNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVK

SEQ ID NO: 24777 - protein, 126 aa, Homo sapiens
  Payload ID: 4905
  Gene Symbol: DDR1
  Gene Name: discoidin domain receptor tyrosine kinase 1
  ENSP ID: ENSP00000427369
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDG

SEQ ID NO: 24778 - protein, 919 aa, Homo sapiens
  Payload ID: 4905
  Gene Symbol: DDR1
  Gene Name: discoidin domain receptor tyrosine kinase 1
  Uniprot ID: Q08345
  ENSP ID: ENSP00000427552
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24779 - protein, 160 aa, Homo sapiens
  Payload ID: 4905
  Gene Symbol: DDR1
  Gene Name: discoidin domain receptor tyrosine kinase 1
  ENSP ID: ENSP00000427597
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMV

SEQ ID NO: 24780 - protein, 767 aa, Homo sapiens; identical to SEQ ID NO: 24730
  Payload ID: 4905
  Gene Symbol: DDR1
  Gene Name: discoidin domain receptor tyrosine kinase 1
  ENSP ID: ENSP00000447357

SEQ ID NO: 24781 - protein, 894 aa, Homo sapiens; identical to SEQ ID NO: 24759
  Payload ID: 4905
  Gene Symbol: DDR1
  Gene Name: discoidin domain receptor tyrosine kinase 1
  Uniprot ID: Q08345
  ENSP ID: ENSP00000447474

SEQ ID NO: 24782 - protein, 894 aa, Homo sapiens; identical to SEQ ID NO: 24759
  Payload ID: 4905
  Gene Symbol: DDR1
  Gene Name: discoidin domain receptor tyrosine kinase 1
  Uniprot ID: Q08345
  ENSP ID: ENSP00000448115

SEQ ID NO: 24783 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000448377

SEQ ID NO: 24784 - protein, 767 aa, Homo sapiens; identical to SEQ ID NO: 24730
  Payload ID: 4905
  Gene Symbol: DDR1
  Gene Name: discoidin domain receptor tyrosine kinase 1
  ENSP ID: ENSP00000448460

SEQ ID NO: 24785 - protein, 767 aa, Homo sapiens; identical to SEQ ID NO: 24730
  Payload ID: 4905
  Gene Symbol: DDR1
  Gene Name: discoidin domain receptor tyrosine kinase 1
  ENSP ID: ENSP00000448797

SEQ ID NO: 24786 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000449190

SEQ ID NO: 24787 - protein, 894 aa, Homo sapiens; identical to SEQ ID NO: 24759
  Payload ID: 4905
  Gene Symbol: DDR1
  Gene Name: discoidin domain receptor tyrosine kinase 1
  Uniprot ID: Q08345
  ENSP ID: ENSP00000449238

SEQ ID NO: 24788 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000449255

SEQ ID NO: 24789 - protein, 894 aa, Homo sapiens; identical to SEQ ID NO: 24759
  Payload ID: 4905
  Gene Symbol: DDR1
  Gene Name: discoidin domain receptor tyrosine kinase 1
  Uniprot ID: Q08345
  ENSP ID: ENSP00000449307

SEQ ID NO: 24790 - protein, 913 aa, Homo sapiens; identical to SEQ ID NO: 24667
  Payload ID: 4905
  Gene Symbol: DDR1
  Gene Name: discoidin domain receptor tyrosine kinase 1
  Uniprot ID: Q08345
  ENSP ID: ENSP00000449611

SEQ ID NO: 24791 - protein, 243 aa, Homo sapiens; identical to SEQ ID NO: 24672
  Payload ID: 4905
  Gene Symbol: DDR1
  Gene Name: discoidin domain receptor tyrosine kinase 1
  Uniprot ID: Q08345
  ENSP ID: ENSP00000479195

SEQ ID NO: 24792 - protein, 243 aa, Homo sapiens; identical to SEQ ID NO: 24672
  Payload ID: 4905
  Gene Symbol: DDR1
  Gene Name: discoidin domain receptor tyrosine kinase 1
  Uniprot ID: Q08345
  ENSP ID: ENSP00000479204

SEQ ID NO: 24793 - protein, 767 aa, Homo sapiens
  Payload ID: 4905
  Gene Symbol: DDR1
  Gene Name: discoidin domain receptor tyrosine kinase 1
  ENSP ID: ENSP00000482421
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKVLESHPRTRSPGLVGIRPTLLPVSPMALVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 24794 - protein, 243 aa, Homo sapiens; identical to SEQ ID NO: 24672
  Payload ID: 4905
  Gene Symbol: DDR1
  Gene Name: discoidin domain receptor tyrosine kinase 1
  Uniprot ID: Q08345
  ENSP ID: ENSP00000484013

SEQ ID NO: 24795 - protein, 243 aa, Homo sapiens; identical to SEQ ID NO: 24672
  Payload ID: 4905
  Gene Symbol: DDR1
  Gene Name: discoidin domain receptor tyrosine kinase 1
  Uniprot ID: Q08345
  ENSP ID: ENSP00000484588

SEQ ID NO: 24796 - protein, 855 aa, Homo sapiens
  Payload ID: 4906
  Gene Symbol: DDR2
  Gene Name: discoidin domain receptor tyrosine kinase 2
  Uniprot ID: Q16832
  ENSP ID: ENSP00000356898
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 24797 - protein, 855 aa, Homo sapiens; identical to SEQ ID NO: 24796
  Payload ID: 4906
  Gene Symbol: DDR2
  Gene Name: discoidin domain receptor tyrosine kinase 2
  Uniprot ID: Q16832
  ENSP ID: ENSP00000356899

SEQ ID NO: 24798 - protein, 148 aa, Homo sapiens
  Payload ID: 4906
  Gene Symbol: DDR2
  Gene Name: discoidin domain receptor tyrosine kinase 2
  ENSP ID: ENSP00000391310
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPY

SEQ ID NO: 24799 - protein, 171 aa, Homo sapiens
  Payload ID: 4906
  Gene Symbol: DDR2
  Gene Name: discoidin domain receptor tyrosine kinase 2
  ENSP ID: ENSP00000396864
  MOD_RES (1)..(1): Any amino acid
XIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVS

SEQ ID NO: 24800 - protein, 130 aa, Homo sapiens
  Payload ID: 4906
  Gene Symbol: DDR2
  Gene Name: discoidin domain receptor tyrosine kinase 2
  ENSP ID: ENSP00000400309
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWI

SEQ ID NO: 24801 - protein, 166 aa, Homo sapiens
  Payload ID: 4906
  Gene Symbol: DDR2
  Gene Name: discoidin domain receptor tyrosine kinase 2
  ENSP ID: ENSP00000417030
LKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRVSREKPQQASGRYDTPAPSSLHLFLVSANLLRSPHSLSRFGLPLLLA

SEQ ID NO: 24802 - protein, 539 aa, Homo sapiens
  Payload ID: 4907
  Gene Symbol: DCBLD1
  Gene Name: discoidin, CUB and LCCL domain containing 1
  Uniprot ID: Q8N8Z6
  ENSP ID: ENSP00000296955
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAG

SEQ ID NO: 24803 - protein, 715 aa, Homo sapiens
  Payload ID: 4907
  Gene Symbol: DCBLD1
  Gene Name: discoidin, CUB and LCCL domain containing 1
  Uniprot ID: Q8N8Z6
  ENSP ID: ENSP00000342422
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 24804 - protein, 99 aa, Homo sapiens
  Payload ID: 4907
  Gene Symbol: DCBLD1
  Gene Name: discoidin, CUB and LCCL domain containing 1
  ENSP ID: ENSP00000391700
NNHKPREWLEIDLGEKKKITGIRTTGSTQSNFNFYVKSFVMNFKNNNSKWKTYKGIVNNEEKVMIHWCGARQVKAPVFQLRKKMRQSQGPSPRKKHPQE

SEQ ID NO: 24805 - protein, 775 aa, Homo sapiens
  Payload ID: 4908
  Gene Symbol: DCBLD2
  Gene Name: discoidin, CUB and LCCL domain containing 2
  Uniprot ID: Q96PD2
  ENSP ID: ENSP00000321573
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 24806 - protein, 789 aa, Homo sapiens
  Payload ID: 4908
  Gene Symbol: DCBLD2
  Gene Name: discoidin, CUB and LCCL domain containing 2
  Uniprot ID: Q96PD2
  ENSP ID: ENSP00000321646
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGFYLMVSLACRHNEGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 24807 - protein, 108 aa, Homo sapiens
  Payload ID: 4908
  Gene Symbol: DCBLD2
  Gene Name: discoidin, CUB and LCCL domain containing 2
  ENSP ID: ENSP00000396803
MGERVRIKFGDFDIEDSDSCHFNYLRIYNGIGVSRTEIGKYCGLGLQMNHSIESKGNEITLLFMSGIHVSGRGFLASYSVIDKQGNFHLLQWFLQFVISNNKNKMLFL

SEQ ID NO: 24808 - protein, 1567 aa, Homo sapiens
  Payload ID: 4909
  Gene Symbol: DIP2A
  Gene Name: disco-interacting protein 2 homolog A
  Uniprot ID: Q14689
  ENSP ID: ENSP00000383133
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 24809 - protein, 1571 aa, Homo sapiens
  Payload ID: 4909
  Gene Symbol: DIP2A
  Gene Name: disco-interacting protein 2 homolog A
  Uniprot ID: Q14689
  ENSP ID: ENSP00000392066
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 24810 - protein, 889 aa, Homo sapiens
  Payload ID: 4909
  Gene Symbol: DIP2A
  Gene Name: disco-interacting protein 2 homolog A
  Uniprot ID: Q14689
  ENSP ID: ENSP00000393434
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQVGAPARPMVR

SEQ ID NO: 24811 - protein, 841 aa, Homo sapiens
  Payload ID: 4909
  Gene Symbol: DIP2A
  Gene Name: disco-interacting protein 2 homolog A
  Uniprot ID: Q14689
  ENSP ID: ENSP00000415089
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 24812 - protein, 798 aa, Homo sapiens
  Payload ID: 4909
  Gene Symbol: DIP2A
  Gene Name: disco-interacting protein 2 homolog A
  Uniprot ID: Q14689
  ENSP ID: ENSP00000430249
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 24813 - protein, 1576 aa, Homo sapiens
  Payload ID: 4910
  Gene Symbol: DIP2B
  Gene Name: disco-interacting protein 2 homolog B
  Uniprot ID: Q9P265
  ENSP ID: ENSP00000301180
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGKLWSRSLKLAYTLLNKLGTKNEPVLKPGDRVALVYPNNDPVMFMVAFYGCLLAEVIPVPIEVPLTRKDAGGQQIGFLLGSCGIALALTSEVCLKGLPKTQNGEIVQFKGWPRLKWVVTDSKYLSKPPKDWQPHISPAGTEPAYIEYKTSKEGSVMGVTVSRLAMLSHCQALSQACNYSEGETIVNVLDFKKDAGLWHGMFANVMNKMHTISVPYSVMKTCPLSWVQRVHAHKAKVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 24814 - protein, 64 aa, Homo sapiens
  Payload ID: 4910
  Gene Symbol: DIP2B
  Gene Name: disco-interacting protein 2 homolog B
  ENSP ID: ENSP00000450181
  MOD_RES (1)..(1): Any amino acid
XALTSEVCLKGLPKTQNGEIVQFKGWPRLKWVVTDSKYLSKPPKDWQPHISPAGTEPAYIEGKQ

SEQ ID NO: 24815 - protein, 1556 aa, Homo sapiens
  Payload ID: 4911
  Gene Symbol: DIP2C
  Gene Name: disco-interacting protein 2 homolog C
  Uniprot ID: Q9Y2E4
  ENSP ID: ENSP00000280886
MADRSLEGMALPLEVRARLAELELELSEGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 24816 - protein, 1537 aa, Homo sapiens
  Payload ID: 4911
  Gene Symbol: DIP2C
  Gene Name: disco-interacting protein 2 homolog C
  ENSP ID: ENSP00000370907
TELHFPSLAGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 24817 - protein, 240 aa, Homo sapiens
  Payload ID: 4911
  Gene Symbol: DIP2C
  Gene Name: disco-interacting protein 2 homolog C
  ENSP ID: ENSP00000397571
  MOD_RES (1)..(1): Any amino acid
XTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEHTSNKGK

SEQ ID NO: 24818 - protein, 130 aa, Homo sapiens
  Payload ID: 4911
  Gene Symbol: DIP2C
  Gene Name: disco-interacting protein 2 homolog C
  ENSP ID: ENSP00000414462
  MOD_RES (1)..(1): Any amino acid
XVSQYKVRDTFCSYSVMELCTKGLGSQTESLKARGLDLSRVRTCVVVAEERPRIALTQSFSKLFKDLGLHPRAVSTSFGCRVNLAICLQCWDYRHEPPRPAPKCFKMVYKEGVRSVGEDKIREKRTKTWR

SEQ ID NO: 24819 - protein, 1622 aa, Homo sapiens
  Payload ID: 4911
  Gene Symbol: DIP2C
  Gene Name: disco-interacting protein 2 homolog C
  ENSP ID: ENSP00000489203
MADRSLEGMALPLEVRARLAELELELSEGDITQKGYEKKRSKLIGAYLPQPPTANGAAVVRCRLQHSEGAPRRTFRSAHIGVCDVREAAARERVASTAGNRPLFYFRFGVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQPHRLWTLAEQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 24820 - protein, 977 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000316377
MKGLSGSRSHHHGVTCDSACDSLSHHSDRKPYLLSPVEHHPADHPYYTQRNSFQAECVGPFSDPLASSTFPRRHYTSQQELKDECALVPRTLATKANRIPANLLDQFERQLPLSRDGYHTLQYKRTAVEHRSDSPGRIRHLVHSVQKLFTKSHSLEGPSKGSVNGGKASPDEAQAARYGKRSKSKERRAEPKARPSTSPGWWSSDDNLDGDMCIYHAPSGVMTMGRCPDRSASQYFLEAYNTISEQAVKASRSNNDVKCSTCANLPVSLDTPLLKKSAWSSTLTVSRAREVYQKASVNMDQAMVKSESCQQERSCQYLQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24821 - protein, 627 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000383010
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 24822 - protein, 675 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000383011
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24823 - protein, 667 aa, Homo sapiens
  Payload ID: 4912
  Gene Symbol: DLGAP1
  Gene Name: discs, large (Drosophila) homolog-associated protein 1
  ENSP ID: ENSP00000383013
MIDLFKAEWVSSVCVQVSRNGRTDQVWVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24824 - protein, 693 aa, Homo sapiens
  Payload ID: 4912
  Gene Symbol: DLGAP1
  Gene Name: discs, large (Drosophila) homolog-associated protein 1
  ENSP ID: ENSP00000383014
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24825 - protein, 683 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000383019
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24826 - protein, 661 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000437817
MDLKTLKLFNSQLRCGWLLYIWNKAFMAHLRVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24827 - protein, 699 aa, Homo sapiens
  Payload ID: 4912
  Gene Symbol: DLGAP1
  Gene Name: discs, large (Drosophila) homolog-associated protein 1
  ENSP ID: ENSP00000445973
MDLKTLKLFNSQLRCGWLLYIWNKAFMAHLRVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24828 - protein, 685 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000446312
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 24829 - protein, 683 aa, Homo sapiens; identical to SEQ ID NO: 24825
  Payload ID: 4912
  Gene Symbol: DLGAP1
  Gene Name: discs, large (Drosophila) homolog-associated protein 1
  Uniprot ID: O14490
  ENSP ID: ENSP00000462848

SEQ ID NO: 24830 - protein, 977 aa, Homo sapiens; identical to SEQ ID NO: 24820
  Payload ID: 4912
  Gene Symbol: DLGAP1
  Gene Name: discs, large (Drosophila) homolog-associated protein 1
  Uniprot ID: O14490
  ENSP ID: ENSP00000462882

SEQ ID NO: 24831 - protein, 929 aa, Homo sapiens
  Payload ID: 4912
  Gene Symbol: DLGAP1
  Gene Name: discs, large (Drosophila) homolog-associated protein 1
  Uniprot ID: O14490
  ENSP ID: ENSP00000463864
MKGLSGSRSHHHGVTCDSACDSLSHHSDRKPYLLSPVEHHPADHPYYTQRNSFQAECVGPFSDPLASSTFPRRHYTSQQELKDECALVPRTLATKANRIPANLLDQFERQLPLSRDGYHTLQYKRTAVEHRSDSPGRIRHLVHSVQKLFTKSHSLEGPSKGSVNGGKASPDEAQAARYGKRSKSKERRAEPKARPSTSPGWWSSDDNLDGDMCIYHAPSGVMTMGRCPDRSASQYFLEAYNTISEQAVKASRSNNDVKCSTCANLPVSLDTPLLKKSAWSSTLTVSRAREVYQKASVNMDQAMVKSESCQQERSCQYLQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 24832 - protein, 975 aa, Homo sapiens
  Payload ID: 4913
  Gene Symbol: DLGAP2
  Gene Name: discs, large (Drosophila) homolog-associated protein 2
  Uniprot ID: Q9P1A6
  ENSP ID: ENSP00000400258
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24833 - protein, 961 aa, Homo sapiens
  Payload ID: 4913
  Gene Symbol: DLGAP2
  Gene Name: discs, large (Drosophila) homolog-associated protein 2
  ENSP ID: ENSP00000430563
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24834 - protein, 975 aa, Homo sapiens
  Payload ID: 4913
  Gene Symbol: DLGAP2
  Gene Name: discs, large (Drosophila) homolog-associated protein 2
  ENSP ID: ENSP00000478085
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILQEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24835 - protein, 961 aa, Homo sapiens
  Payload ID: 4913
  Gene Symbol: DLGAP2
  Gene Name: discs, large (Drosophila) homolog-associated protein 2
  ENSP ID: ENSP00000483427
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILQEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24836 - protein, 961 aa, Homo sapiens; identical to SEQ ID NO: 24833
  Payload ID: 4913
  Gene Symbol: DLGAP2
  Gene Name: discs, large (Drosophila) homolog-associated protein 2
  ENSP ID: ENSP00000484215

SEQ ID NO: 24837 - protein, 176 aa, Homo sapiens
  Payload ID: 4913
  Gene Symbol: DLGAP2
  Gene Name: discs, large (Drosophila) homolog-associated protein 2
  ENSP ID: ENSP00000487701
  MOD_RES (1)..(1): Any amino acid
XTATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEESKSSGFPRAS

SEQ ID NO: 24838 - protein, 400 aa, Homo sapiens
  Payload ID: 4913
  Gene Symbol: DLGAP2
  Gene Name: discs, large (Drosophila) homolog-associated protein 2
  ENSP ID: ENSP00000487728
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQ

SEQ ID NO: 24839 - protein, 158 aa, Homo sapiens
  Payload ID: 4913
  Gene Symbol: DLGAP2
  Gene Name: discs, large (Drosophila) homolog-associated protein 2
  ENSP ID: ENSP00000488020
SAVRTVRTQGLFSYREDYRTQVDTSTLPPPDPWLEPAIDTVETGRMSPCRRDGSWFLKLLHAETKRMEGWCKEMEREAEENDLSEEKLLPAHALQENALALCQREVDGGDDGRRMLGRCCLPRDPQSPQHGCMGLVQVSTAVFRSFTRRLHFSWLGYI

SEQ ID NO: 24840 - protein, 961 aa, Homo sapiens; identical to SEQ ID NO: 24835
  Payload ID: 4913
  Gene Symbol: DLGAP2
  Gene Name: discs, large (Drosophila) homolog-associated protein 2
  ENSP ID: ENSP00000488195

SEQ ID NO: 24841 - protein, 561 aa, Homo sapiens
  Payload ID: 4913
  Gene Symbol: DLGAP2
  Gene Name: discs, large (Drosophila) homolog-associated protein 2
  ENSP ID: ENSP00000488273
  MOD_RES (1)..(1): Any amino acid
XQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24842 - protein, 158 aa, Homo sapiens; identical to SEQ ID NO: 24839
  Payload ID: 4913
  Gene Symbol: DLGAP2
  Gene Name: discs, large (Drosophila) homolog-associated protein 2
  ENSP ID: ENSP00000488445

SEQ ID NO: 24843 - protein, 176 aa, Homo sapiens; identical to SEQ ID NO: 24837
  Payload ID: 4913
  Gene Symbol: DLGAP2
  Gene Name: discs, large (Drosophila) homolog-associated protein 2
  ENSP ID: ENSP00000488645
  MOD_RES (1)..(1): Any amino acid

SEQ ID NO: 24844 - protein, 575 aa, Homo sapiens
  Payload ID: 4913
  Gene Symbol: DLGAP2
  Gene Name: discs, large (Drosophila) homolog-associated protein 2
  ENSP ID: ENSP00000488705
  MOD_RES (1)..(1): Any amino acid
XQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 24845 - protein, 400 aa, Homo sapiens; identical to SEQ ID NO: 24838
  Payload ID: 4913
  Gene Symbol: DLGAP2
  Gene Name: discs, large (Drosophila) homolog-associated protein 2
  ENSP ID: ENSP00000488908

SEQ ID NO: 24846 - protein, 979 aa, Homo sapiens
  Payload ID: 4914
  Gene Symbol: DLGAP3
  Gene Name: discs, large (Drosophila) homolog-associated protein 3
  Uniprot ID: O95886
  ENSP ID: ENSP00000235180
MRGYHGDRGSHPRPARFADQQHMDVGPAARAPYLLGSREAFSTEPRFCAPRAGLGHISPEGPLSLSEGPSVGPEGGPAGAGVGGGSSTFPRMYPGQGPFDTCEDCVGHPQGKGAPRLPPTLLDQFEKQLPVQQDGFHTLPYQRGPAGAGPGPAPGTGTAPEPRSESPSRIRHLVHSVQKLFAKSHSLEAPGKRDYNGPKAEGRGGSGGDSYPGPGSGGPHTSHHHHHHHHHHHHQSRHGKRSKSKDRKGDGRHQAKSTGWWSSDDNLDSDSGFLAGGRPPGEPGGPFCLEGPDGSYRDLSFKGRSGGSEGRCLACTGMSMSLDGQSVKRSAWHTMMVSQGRDGYPGAGPGKGLLGPETKAKARTYHYLQVPQDDWGGYPTGGKDGEIPCRRMRSGSYIKAMGDEESGDSDGSPKTSPKAVARRFTTRRSSSVDQARINCCVPPRIHPRSSIPGYSRSLTTGQLSDELNQQLEAVCGSVFGELESQAVDALDLPGCFRMRSHSYLRAIQAGCSQDDDCLPLLATPAAVSGRPGSSFNFRKAPPPIPPGSQAPPRISITAQSSTDSAHESFTAAEGPARRCSSADGLDGPAMGARTLELAPVPPRASPKPPTLIIKTIPGREELRSLARQRKWRPSIGVQVETISDSDTENRSRREFHSIGVQVEEDKRRARFKRSNSVTAGVQADLELEGLAGLATVATEDKALQFGRSFQRHASEPQPGPRAPTYSVFRTVHTQGQWAYREGYPLPYEPPATDGSPGPAPAPTPGPGAGRRDSWIERGSRSLPDSGRASPCPRDGEWFIKMLRAEVEKLEHWCQQMEREAEDYELPEEILEKIRSAVGSTQLLLSQKVQQFFRLCQQSMDPTAFPVPTFQDLAGFWDLLQLSIEDVTLKFLELQQLKANSWKLLEPKEEKKVPPPIPKKPLRGRGVPVKERSLDSVDRQRQEARKRLLAAKRAASFRHSSATESADSIEIYIPEAQTRL

SEQ ID NO: 24847 - protein, 979 aa, Homo sapiens; identical to SEQ ID NO: 24846
  Payload ID: 4914
  Gene Symbol: DLGAP3
  Gene Name: discs, large (Drosophila) homolog-associated protein 3
  Uniprot ID: O95886
  ENSP ID: ENSP00000362444

SEQ ID NO: 24848 - protein, 992 aa, Homo sapiens
  Payload ID: 4915
  Gene Symbol: DLGAP4
  Gene Name: discs, large (Drosophila) homolog-associated protein 4
  Uniprot ID: Q9Y2H0
  ENSP ID: ENSP00000341633
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 24849 - protein, 453 aa, Homo sapiens
  Payload ID: 4915
  Gene Symbol: DLGAP4
  Gene Name: discs, large (Drosophila) homolog-associated protein 4
  Uniprot ID: Q9Y2H0
  ENSP ID: ENSP00000345700
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 24850 - protein, 992 aa, Homo sapiens; identical to SEQ ID NO: 24848
  Payload ID: 4915
  Gene Symbol: DLGAP4
  Gene Name: discs, large (Drosophila) homolog-associated protein 4
  Uniprot ID: Q9Y2H0
  ENSP ID: ENSP00000363014

SEQ ID NO: 24851 - protein, 989 aa, Homo sapiens
  Payload ID: 4915
  Gene Symbol: DLGAP4
  Gene Name: discs, large (Drosophila) homolog-associated protein 4
  Uniprot ID: Q9Y2H0
  ENSP ID: ENSP00000363023
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQERTRRNGSHLSEDNGPKAIDVMAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 24852 - protein, 989 aa, Homo sapiens; identical to SEQ ID NO: 24851
  Payload ID: 4915
  Gene Symbol: DLGAP4
  Gene Name: discs, large (Drosophila) homolog-associated protein 4
  Uniprot ID: Q9Y2H0
  ENSP ID: ENSP00000384954

SEQ ID NO: 24853 - protein, 244 aa, Homo sapiens
  Payload ID: 4915
  Gene Symbol: DLGAP4
  Gene Name: discs, large (Drosophila) homolog-associated protein 4
  ENSP ID: ENSP00000419311
MAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKVSMEQCGGEVQGQIPGRQ

SEQ ID NO: 24854 - protein, 285 aa, Homo sapiens
  Payload ID: 4915
  Gene Symbol: DLGAP4
  Gene Name: discs, large (Drosophila) homolog-associated protein 4
  ENSP ID: ENSP00000477723
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 24855 - protein, 46 aa, Homo sapiens
  Payload ID: 4915
  Gene Symbol: DLGAP4
  Gene Name: discs, large (Drosophila) homolog-associated protein 4
  ENSP ID: ENSP00000480166
MSSRRDTDSDTQDANDSSCKSSERSLPDCTPHPNSISIDAGPRQAP

SEQ ID NO: 24856 - protein, 125 aa, Homo sapiens
  Payload ID: 4915
  Gene Symbol: DLGAP4
  Gene Name: discs, large (Drosophila) homolog-associated protein 4
  ENSP ID: ENSP00000484696
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKEN

SEQ ID NO: 24857 - protein, 846 aa, Homo sapiens
  Payload ID: 4916
  Gene Symbol: DLGAP5
  Gene Name: discs, large (Drosophila) homolog-associated protein 5
  Uniprot ID: Q15398
  ENSP ID: ENSP00000247191
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 24858 - protein, 842 aa, Homo sapiens
  Payload ID: 4916
  Gene Symbol: DLGAP5
  Gene Name: discs, large (Drosophila) homolog-associated protein 5
  Uniprot ID: Q15398
  ENSP ID: ENSP00000378815
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSVGSCYVARAGLEVLGSSDPTTSASRVAGTTARSKLQ

SEQ ID NO: 24859 - protein, 234 aa, Homo sapiens
  Payload ID: 4916
  Gene Symbol: DLGAP5
  Gene Name: discs, large (Drosophila) homolog-associated protein 5
  ENSP ID: ENSP00000451747
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAAN

SEQ ID NO: 24860 - protein, 111 aa, Homo sapiens
  Payload ID: 4916
  Gene Symbol: DLGAP5
  Gene Name: discs, large (Drosophila) homolog-associated protein 5
  ENSP ID: ENSP00000452168
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQRE

SEQ ID NO: 24861 - protein, 926 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000345731
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24862 - protein, 892 aa, Homo sapiens
  Payload ID: 4917
  Gene Symbol: DLG1
  Gene Name: discs, large homolog 1 (Drosophila)
  ENSP ID: ENSP00000350303
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24863 - protein, 208 aa, Homo sapiens
  Payload ID: 4917
  Gene Symbol: DLG1
  Gene Name: discs, large homolog 1 (Drosophila)
  ENSP ID: ENSP00000376185
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLE

SEQ ID NO: 24864 - protein, 658 aa, Homo sapiens
  Payload ID: 4917
  Gene Symbol: DLG1
  Gene Name: discs, large homolog 1 (Drosophila)
  ENSP ID: ENSP00000376186
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRYACFLPLECEAT

SEQ ID NO: 24865 - protein, 871 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000376187
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24866 - protein, 106 aa, Homo sapiens
  Payload ID: 4917
  Gene Symbol: DLG1
  Gene Name: discs, large homolog 1 (Drosophila)
  ENSP ID: ENSP00000390403
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVE

SEQ ID NO: 24867 - protein, 904 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000391732
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24868 - protein, 123 aa, Homo sapiens
  Payload ID: 4917
  Gene Symbol: DLG1
  Gene Name: discs, large homolog 1 (Drosophila)
  ENSP ID: ENSP00000393771
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISP

SEQ ID NO: 24869 - protein, 179 aa, Homo sapiens
  Payload ID: 4917
  Gene Symbol: DLG1
  Gene Name: discs, large homolog 1 (Drosophila)
  ENSP ID: ENSP00000396474
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTY

SEQ ID NO: 24870 - protein, 800 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000396658
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYLILITDEYGCSKGGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24871 - protein, 370 aa, Homo sapiens
  Payload ID: 4917
  Gene Symbol: DLG1
  Gene Name: discs, large homolog 1 (Drosophila)
  ENSP ID: ENSP00000396768
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITN

SEQ ID NO: 24872 - protein, 286 aa, Homo sapiens
  Payload ID: 4917
  Gene Symbol: DLG1
  Gene Name: discs, large homolog 1 (Drosophila)
  ENSP ID: ENSP00000398702
FFTRRHSFIDCISVATSSTQANPPPVLVNTDSLETPTYGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLG

SEQ ID NO: 24873 - protein, 788 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000398939
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24874 - protein, 35 aa, Homo sapiens
  Payload ID: 4917
  Gene Symbol: DLG1
  Gene Name: discs, large homolog 1 (Drosophila)
  ENSP ID: ENSP00000400169
MPVRKQDTQRALHLLEEYRSKLSQTEDRQLRSSIE

SEQ ID NO: 24875 - protein, 904 aa, Homo sapiens; identical to SEQ ID NO: 24867
  Payload ID: 4917
  Gene Symbol: DLG1
  Gene Name: discs, large homolog 1 (Drosophila)
  Uniprot ID: Q12959
  ENSP ID: ENSP00000407531

SEQ ID NO: 24876 - protein, 893 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000411278
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24877 - protein, 122 aa, Homo sapiens
  Payload ID: 4917
  Gene Symbol: DLG1
  Gene Name: discs, large homolog 1 (Drosophila)
  ENSP ID: ENSP00000412579
MDCLCIVTTKKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGR

SEQ ID NO: 24878 - protein, 853 aa, Homo sapiens
  Payload ID: 4917
  Gene Symbol: DLG1
  Gene Name: discs, large homolog 1 (Drosophila)
  Uniprot ID: Q12959
  ENSP ID: ENSP00000413238
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 24879 - protein, 154 aa, Homo sapiens
  Payload ID: 4917
  Gene Symbol: DLG1
  Gene Name: discs, large homolog 1 (Drosophila)
  ENSP ID: ENSP00000414189
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSH

SEQ ID NO: 24880 - protein, 909 aa, Homo sapiens
  Payload ID: 4918
  Gene Symbol: DLG2
  Gene Name: discs, large homolog 2 (Drosophila)
  Uniprot ID: Q15700
  ENSP ID: ENSP00000280241
MNAYLTKQHSCSRGSDGMDAVRSAPTLIRDAHCACGWQRNCQGLGYSSQTMPSSGPGGPASNRTGGSSFNRTLWDSVRKSPHKTSTKGKGTCGEHCTCPHGWFSPAQASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24881 - protein, 975 aa, Homo sapiens
  Payload ID: 4918
  Gene Symbol: DLG2
  Gene Name: discs, large homolog 2 (Drosophila)
  Uniprot ID: Q15700
  ENSP ID: ENSP00000365272
MGIFKSSLFQALLDIQEFYEVTLLNSQKSCEQKIEEANQVLQKWEKTSLLAPCHDRLQKSSELTDCSGSKENASCIEQNKENQSFENETDETTTQNQGRCPAQNCSVEAPAWMPVHHCTKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24882 - protein, 232 aa, Homo sapiens
  Payload ID: 4918
  Gene Symbol: DLG2
  Gene Name: discs, large homolog 2 (Drosophila)
  ENSP ID: ENSP00000381344
MTKVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEY

SEQ ID NO: 24883 - protein, 552 aa, Homo sapiens
  Payload ID: 4918
  Gene Symbol: DLG2
  Gene Name: discs, large homolog 2 (Drosophila)
  ENSP ID: ENSP00000381346
MNAYLTKQHSCSRGSDGMDAVRSAPTLIRDAHCACGWQRNCQGLGYSSQTMPSSGPGGPASNRTGGSSFNRTLWDSVRKSPHKTSTKGKGTCGEHCTCPHGWFSPAQASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEGQSELKLIMF

SEQ ID NO: 24884 - protein, 129 aa, Homo sapiens
  Payload ID: 4918
  Gene Symbol: DLG2
  Gene Name: discs, large homolog 2 (Drosophila)
  ENSP ID: ENSP00000381349
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLNTFFIC

SEQ ID NO: 24885 - protein, 791 aa, Homo sapiens
  Payload ID: 4918
  Gene Symbol: DLG2
  Gene Name: discs, large homolog 2 (Drosophila)
  ENSP ID: ENSP00000381353
MQHAFIPASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24886 - protein, 870 aa, Homo sapiens
  Payload ID: 4918
  Gene Symbol: DLG2
  Gene Name: discs, large homolog 2 (Drosophila)
  Uniprot ID: Q15700
  ENSP ID: ENSP00000381355
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24887 - protein, 348 aa, Homo sapiens
  Payload ID: 4918
  Gene Symbol: DLG2
  Gene Name: discs, large homolog 2 (Drosophila)
  ENSP ID: ENSP00000385113
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLKHVSSNASDSESSYRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24888 - protein, 221 aa, Homo sapiens
  Payload ID: 4918
  Gene Symbol: DLG2
  Gene Name: discs, large homolog 2 (Drosophila)
  ENSP ID: ENSP00000391017
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDI

SEQ ID NO: 24889 - protein, 334 aa, Homo sapiens
  Payload ID: 4918
  Gene Symbol: DLG2
  Gene Name: discs, large homolog 2 (Drosophila)
  Uniprot ID: Q15700
  ENSP ID: ENSP00000393049
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24890 - protein, 749 aa, Homo sapiens
  Payload ID: 4918
  Gene Symbol: DLG2
  Gene Name: discs, large homolog 2 (Drosophila)
  Uniprot ID: Q15700
  ENSP ID: ENSP00000402275
MQRPSVSRAENYQLLWDTIASLKQCEQAMQHAFIPVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24891 - protein, 108 aa, Homo sapiens
  Payload ID: 4918
  Gene Symbol: DLG2
  Gene Name: discs, large homolog 2 (Drosophila)
  ENSP ID: ENSP00000403239
MSFDSQCDLRSSEPDYARFEAKIHDLREQMMNHSMSSGSGSLRTNQKRSLYVRAMFDYDKSKDSGLPSQGLSFKYGDILHVINASDDEWWQARRVMLEGDSEEMGVIP

SEQ ID NO: 24892 - protein, 165 aa, Homo sapiens
  Payload ID: 4918
  Gene Symbol: DLG2
  Gene Name: discs, large homolog 2 (Drosophila)
  ENSP ID: ENSP00000409133
RKKSFIFSRKFPFYKNKEQSEQETSDPELNYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTE

SEQ ID NO: 24893 - protein, 866 aa, Homo sapiens
  Payload ID: 4918
  Gene Symbol: DLG2
  Gene Name: discs, large homolog 2 (Drosophila)
  ENSP ID: ENSP00000432894
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLKHVSSNASDSESSYRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24894 - protein, 811 aa, Homo sapiens
  Payload ID: 4918
  Gene Symbol: DLG2
  Gene Name: discs, large homolog 2 (Drosophila)
  ENSP ID: ENSP00000433848
MQRPSVSRAENYQLLWDTIASLKQCEQAMQHAFIPASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGSFNDKRKKSFIFSRKFPFYKNKEQSEQETSDPERGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTGKFTFTLVV

SEQ ID NO: 24895 - protein, 37 aa, Homo sapiens
  Payload ID: 4918
  Gene Symbol: DLG2
  Gene Name: discs, large homolog 2 (Drosophila)
  ENSP ID: ENSP00000434095
MQRPSVSRAENYQLLWDTIASLKQCEQAMQHAFIPLE

SEQ ID NO: 24896 - protein, 93 aa, Homo sapiens
  Payload ID: 4918
  Gene Symbol: DLG2
  Gene Name: discs, large homolog 2 (Drosophila)
  ENSP ID: ENSP00000434346
MMNHSMSSGSGSLRTNQKRSLYVRAMFDYDKSKDSGLPSQGLSFKYGDILHVINASDDEWWQARRVMLEGDSEEMGVIPSKRRVERKERARLK

SEQ ID NO: 24897 - protein, 74 aa, Homo sapiens
  Payload ID: 4918
  Gene Symbol: DLG2
  Gene Name: discs, large homolog 2 (Drosophila)
  ENSP ID: ENSP00000435809
MDCLCIVTTKQNQGRCPAQNCSVEAPAWMPVHHCTKYRYQDEDAPHDHSLPRLTHEVRGPELVHVSEKNLSQIE

SEQ ID NO: 24898 - protein, 852 aa, Homo sapiens
  Payload ID: 4918
  Gene Symbol: DLG2
  Gene Name: discs, large homolog 2 (Drosophila)
  ENSP ID: ENSP00000435849
MFFACYCALRTNVKKYRYQDEDAPHDHSLPRLTHEVRGPELVHVSEKNLSQIENVHGYVLQSHISPLKASPAPIIVNTDTLDTIPYVNGTEIEYEFEEITLERGNSGLGFSIAGGTDNPHIGDDPGIFITKIIPGGAAAEDGRLRVNDCILRVNEVDVSEVSHSKAVEALKEAGSIVRLYVRRRRPILETVVEIKLFKGPKGLGFSIAGGVGNQHIPGDNSIYVTKIIDGGAAQKDGRLQVGDRLLMVNNYSLEEVTHEEAVAILKNTSEVVYLKVGKPTTIYMTDPYGPPDITHSYSPPMENHLLSGNNGTLEYKTSLPPISPGRYSPIPKHMLVDDDYTRPPEPVYSTVNKLCDKPASPRHYSPVECDKSFLLSAPYSHYHLGLLPDSEMTSHSQHSTATRQPSMTLQRAVSLEGEPRKVVLHKGSTGLGFNIVGGEDGEGIFVSFILAGGPADLSGELQRGDQILSVNGIDLRGASHEQAAAALKGAGQTVTIIAQYQPEDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGDIPGLGDDGYGTKTLRGQEDLILSYEPVTRQEINYTRPVIILGPMKDRINDDLISEFPDKFGSCVPHTTRPKRDYEVDGRDYHFVISREQMEKDIQEHKFIEAGQYNDNLYGTSVQSVRFVAERGKHCILDVSGNAIKRLQVAQLYPIAIFIKPRSLEPLMEMNKRLTEEQAKKTYDRAIKLEQEFGEYFTAIVQGDTLEDIYNQCKLVIEEQSGPFIWIPSKEKL

SEQ ID NO: 24899 - protein, 109 aa, Homo sapiens
  Payload ID: 4918
  Gene Symbol: DLG2
  Gene Name: discs, large homolog 2 (Drosophila)
  ENSP ID: ENSP00000436020
MMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGD

SEQ ID NO: 24900 - protein, 142 aa, Homo sapiens
  Payload ID: 4918
  Gene Symbol: DLG2
  Gene Name: discs, large homolog 2 (Drosophila)
  ENSP ID: ENSP00000436302
MLKTPGNLLKSCDYARFEAKIHDLREQMMNHSMSSGSGSLRTNQKRSLYVRAMFDYDKSKDSGLPSQGLSFKYGDILHVINASDDEWWQARRVMLEGDSEEMGVIPSKRRVERKERARLKTVKFNAKPGVIDSKGLLEFKYA

SEQ ID NO: 24901 - protein, 849 aa, Homo sapiens
  Payload ID: 4919
  Gene Symbol: DLG3
  Gene Name: discs, large homolog 3 (Drosophila)
  ENSP ID: ENSP00000194900
MHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQARPAPLLVNPETLKHSLSVNGSDGMFKYEEIVLERGNSGLGFSIAGGIDNPHVPDDPGIFITKIIPGGAAAMDGRLGVNDCVLRVNEVDVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 24902 - protein, 512 aa, Homo sapiens
  Payload ID: 4919
  Gene Symbol: DLG3
  Gene Name: discs, large homolog 3 (Drosophila)
  Uniprot ID: Q92796
  ENSP ID: ENSP00000363475
MERARKFSGSGLAMGLGSASASAWRRASQRWAWPLRSLRPGGDAREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 24903 - protein, 817 aa, Homo sapiens
  Payload ID: 4919
  Gene Symbol: DLG3
  Gene Name: discs, large homolog 3 (Drosophila)
  Uniprot ID: Q92796
  ENSP ID: ENSP00000363480
MHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEIVLERGNSGLGFSIAGGIDNPHVPDDPGIFITKIIPGGAAAMDGRLGVNDCVLRVNEVDVSEVVHSRAVEALKEAGPVVRLVVRRRQPPPETIMEVNLLKGPKGLGFSIAGGIGNQHIPGDNSIYITKIIEGGAAQKDGRLQIGDRLLAVNNTNLQDVRHEEAVASLKNTSDMVYLKVAKPGSLHLNDMYAPPDYASTFTALADNHISHNSSLGYLGAVESKVSYPAPPQVPPTRYSPIPRHMLAEEDFTREPRKIILHKGSTGLGFNIVGGEDGEGIFVSFILAGGPADLSGELRRGDRILSVNGVNLRNATHEQAAAALKRAGQSVTIVAQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 24904 - protein, 366 aa, Homo sapiens
  Payload ID: 4919
  Gene Symbol: DLG3
  Gene Name: discs, large homolog 3 (Drosophila)
  Uniprot ID: Q92796
  ENSP ID: ENSP00000441393
MMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRSIKTKRKKSFRLSRKFPFYKSKENMAQESSIQEQGVTSNTSDSESSSKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 24905 - protein, 721 aa, Homo sapiens
  Payload ID: 4920
  Gene Symbol: DLG4
  Gene Name: discs, large homolog 4 (Drosophila)
  Uniprot ID: P78352
  ENSP ID: ENSP00000307471
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 24906 - protein, 724 aa, Homo sapiens
  Payload ID: 4920
  Gene Symbol: DLG4
  Gene Name: discs, large homolog 4 (Drosophila)
  Uniprot ID: P78352
  ENSP ID: ENSP00000382425
MDCLCIVTTKKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 24907 - protein, 767 aa, Homo sapiens
  Payload ID: 4920
  Gene Symbol: DLG4
  Gene Name: discs, large homolog 4 (Drosophila)
  Uniprot ID: P78352
  ENSP ID: ENSP00000382428
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 24908 - protein, 234 aa, Homo sapiens
  Payload ID: 4920
  Gene Symbol: DLG4
  Gene Name: discs, large homolog 4 (Drosophila)
  ENSP ID: ENSP00000388122
MDCLCIVTTKKYRYQDEDTPPLEHSPAHLPNQVNAPELVHVAERNLSHLEAGHGVVGHAHLSPFKANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDG

SEQ ID NO: 24909 - protein, 281 aa, Homo sapiens
  Payload ID: 4920
  Gene Symbol: DLG4
  Gene Name: discs, large homolog 4 (Drosophila)
  ENSP ID: ENSP00000407918
MPINGVNLAWKYRYQDEDTPPLEHSPAHLPNQVNAPELVHVAERNLSHLEAGHGVVGHAHLSPFKANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSN

SEQ ID NO: 24910 - protein, 296 aa, Homo sapiens
  Payload ID: 4920
  Gene Symbol: DLG4
  Gene Name: discs, large homolog 4 (Drosophila)
  ENSP ID: ENSP00000460625
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTCESPSNTKVPHDPSRLTHDMQSHDIPVAVPLQIFPMK

SEQ ID NO: 24911 - protein, 115 aa, Homo sapiens
  Payload ID: 4920
  Gene Symbol: DLG4
  Gene Name: discs, large homolog 4 (Drosophila)
  ENSP ID: ENSP00000465720
MEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIA

SEQ ID NO: 24912 - protein, 91 aa, Homo sapiens
  Payload ID: 4920
  Gene Symbol: DLG4
  Gene Name: discs, large homolog 4 (Drosophila)
  ENSP ID: ENSP00000465789
MEYEEITLERGNSGLGFSIAGGTDNPHIGDDPSIFITKIIPGGAAAQDGRLRVNDSILFVNEVDVREVTHSAAVEALKEAGSIVRLYVMRR

SEQ ID NO: 24913 - protein, 85 aa, Homo sapiens
  Payload ID: 4920
  Gene Symbol: DLG4
  Gene Name: discs, large homolog 4 (Drosophila)
  ENSP ID: ENSP00000467897
  MOD_RES (1)..(1): Any amino acid
XGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 24914 - protein, 1919 aa, Homo sapiens
  Payload ID: 4921
  Gene Symbol: DLG5
  Gene Name: discs, large homolog 5 (Drosophila)
  Uniprot ID: Q8TDM6
  ENSP ID: ENSP00000361467
MEPQRRELLAQCQQSLAQAMTEVEAVLGLLEAAGALSPGERRQLDEEAGGAKAELLLKLLLAKERDHFQDLRAALEKTQPHLLPILYLNGVVGPPQPAEGAGSTYSVLSTMPSDSESSSSLSSVGTTGKAPSPPPLLTDQQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQVLKHNGSSEILNKLYDTAMDKLEVVKKDYDALRKRYSEKVAIHNADLSRLEQLGEENQRLLKQTEMLTQQRDTAIQLQHQCALSLRRFEAIHHELNKATAQNKDLQWEMELLQSELTELRTTQVKTAKESEKYREERDAVYSEYKLIMSERDQVISELDKLQTEVELAESKLKSSTSEKKAANEEMEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 24915 - protein, 880 aa, Homo sapiens
  Payload ID: 4921
  Gene Symbol: DLG5
  Gene Name: discs, large homolog 5 (Drosophila)
  ENSP ID: ENSP00000394797
GAINMVVRRRKSLGGKVVTPLHINLSGQKDSGISLENGVYAAAVLPGSPAAKEGSLAVGDRIVAINGIALDNKSLNECESLLRSCQDSLTLSLLKEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEYGSLDVRNKTVEEVYVEMLKPRDGVRLKVQYRPEEFTKAKGLPGDSFYIRALYDRLADVEQELSFKKDDILYVDDTLPQGTFGSWMAWQLDENAQKIQRGQIPSKYVMDQEFSRRLSMSEVKDDNSATKTLSAAARRSFFRRKHKHKRSGSKDGKDLLALDAFSSDSIPLFEDSVSLAYQRVQKVDCTALRPVLILGPLLDVVKEMLVNEAPGKFCRCPLEVMKASQQAIERGVKDCLFVDYKRRSGHFDVTTVASIKEITEKNRHCLLDIAPHAIERLHHMHIYPIVIFIHYKSAKHIKEQRDPIYLRDKVTQRHSKEQFEAAQKLEQEYSRYFTGVIQGGALSSICTQILAMVNQEQNKVLWIPACPL

SEQ ID NO: 24916 - protein, 214 aa, Homo sapiens
  Payload ID: 4921
  Gene Symbol: DLG5
  Gene Name: discs, large homolog 5 (Drosophila)
  ENSP ID: ENSP00000473298
SATVLDTHGKQVAFVMSWWTECAVSTGSTYSVLSTMPSDSESSSSLSSVGTTGKAPSPPPLLTDQQVNEKVENLSIQLRLMTRERNELRKRLAFATHGTAFDKRPYHRLNPDYERLKIQCVRAMSDLQSLQNQHTNALKRCEEVAKETDFYHTLHSRLLSDQTRLKDDVDMLRRENGQLLRERNLLQQSWEDMKRLHEEDQKEIGDLRAQQQQS

SEQ ID NO: 24917 - protein, 1919 aa, Homo sapiens; identical to SEQ ID NO: 24914
  Payload ID: 4921
  Gene Symbol: DLG5
  Gene Name: discs, large homolog 5 (Drosophila)
  Uniprot ID: Q8TDM6
  ENSP ID: ENSP00000484894

SEQ ID NO: 24918 - protein, 880 aa, Homo sapiens; identical to SEQ ID NO: 24915
  Payload ID: 4921
  Gene Symbol: DLG5
  Gene Name: discs, large homolog 5 (Drosophila)
  ENSP ID: ENSP00000488188

SEQ ID NO: 24919 - protein, 214 aa, Homo sapiens; identical to SEQ ID NO: 24916
  Payload ID: 4921
  Gene Symbol: DLG5
  Gene Name: discs, large homolog 5 (Drosophila)
  ENSP ID: ENSP00000488289

SEQ ID NO: 24920 - protein, 598 aa, Homo sapiens
  Payload ID: 4921
  Gene Symbol: DLG5
  Gene Name: discs, large homolog 5 (Drosophila)
  ENSP ID: ENSP00000488845
  MOD_RES (1)..(1): Any amino acid
XQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDRPYVEEPRHVKVQKGSEPLGISIVSGEKGGIYVSKVTVGSIAHQAGLEYGDQLLEFNGINLRSATEQQARLIIGQQCDTITILAQYNPHVHQLSSHSRSSSHLDPAGTHSTLQGSGTTTPEHPSVIDPLMEQDEGPSTPPAKQSSSRIAGDANKKTLEPRVVFIKKSQLELGVHLCGGNLHGVFVAEVEDDSPAKGPDGLVPGDLILEPGRAEQDSGGSLCGDAEAQGWRPPEGAVPP

SEQ ID NO: 24921 - protein, 1068 aa, Homo sapiens
  Payload ID: 4922
  Gene Symbol: DAAM1
  Gene Name: dishevelled associated activator of morphogenesis 1
  Uniprot ID: Q9Y4D1
  ENSP ID: ENSP00000354162
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 24922 - protein, 1078 aa, Homo sapiens
  Payload ID: 4922
  Gene Symbol: DAAM1
  Gene Name: dishevelled associated activator of morphogenesis 1
  Uniprot ID: Q9Y4D1
  ENSP ID: ENSP00000378557
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 24923 - protein, 96 aa, Homo sapiens
  Payload ID: 4922
  Gene Symbol: DAAM1
  Gene Name: dishevelled associated activator of morphogenesis 1
  ENSP ID: ENSP00000450498
MAPRKRGGRGISFIFCCFRNNDHPEITYRLRNDSNFALQTMEPALPMPPVEELDVMFSELVDELDLTDKHREAMFALPAEKKWQIYCSKKKVRFSL

SEQ ID NO: 24924 - protein, 1068 aa, Homo sapiens
  Payload ID: 4923
  Gene Symbol: DAAM2
  Gene Name: dishevelled associated activator of morphogenesis 2
  Uniprot ID: Q86T65
  ENSP ID: ENSP00000274867
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 24925 - protein, 1068 aa, Homo sapiens; identical to SEQ ID NO: 24924
  Payload ID: 4923
  Gene Symbol: DAAM2
  Gene Name: dishevelled associated activator of morphogenesis 2
  Uniprot ID: Q86T65
  ENSP ID: ENSP00000381876

SEQ ID NO: 24926 - protein, 132 aa, Homo sapiens
  Payload ID: 4923
  Gene Symbol: DAAM2
  Gene Name: dishevelled associated activator of morphogenesis 2
  ENSP ID: ENSP00000384637
MAPRKRSHHGLGFLCCFGGSDIPEINLRDNHPLQFMEFSSPIPNAEELNIRFAELVDELDLTDKNREAMFALPPEKKWQIYCSKKKVPSLTPLATSQGSWHGVALAALACSCIHLMFITCQPCSRCWRNNSE

SEQ ID NO: 24927 - protein, 1067 aa, Homo sapiens
  Payload ID: 4923
  Gene Symbol: DAAM2
  Gene Name: dishevelled associated activator of morphogenesis 2
  Uniprot ID: Q86T65
  ENSP ID: ENSP00000437808
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVLEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 24928 - protein, 97 aa, Homo sapiens
  Payload ID: 4923
  Gene Symbol: DAAM2
  Gene Name: dishevelled associated activator of morphogenesis 2
  ENSP ID: ENSP00000488196
MAPRKRSHHGLGFLCCFGGSDIPEINLRDNHPLQFMEFSSPIPNAEELNIRFAELVDELDLTDKNREAMFALPPEKKWQIYCSKKKPCSRCWRNNSE

SEQ ID NO: 24929 - protein, 1077 aa, Homo sapiens
  Payload ID: 4923
  Gene Symbol: DAAM2
  Gene Name: dishevelled associated activator of morphogenesis 2
  ENSP ID: ENSP00000488831
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPPPPPPLPFACCPPPPPPPLPPGGPPTPPGAPPCLGMGLPLPQDPYPSSDVPLRKKRVPQPSHPLKSFNWVKLNEERVPGTVWNEIDDMQVFRILDLEDFEKMFSAYQRHQELITNPSQQKELGSTEDIYLASRKVKELSVIDGRRAQNCIILLSKLKLSNEEIRQAILKMDEQEDLAKDMLEQLLKFIPEKSDIDLLEEHKHEIERMARADRFLYEMSRIDHYQQRLQALFFKKKFQERLAEAKPKVEAILLASRELVRSKRLRQMLEVILAIGNFMNKGQRGGAYGFRVASLNKIADTKSSIDRNISLLHYLIMILEKHFPDILNMPSELQHLPEAAKVNLAELEKEVGNLRRGLRAVEVELEYQRRQVREPSDKFVPVMSDFITVSSFSFSELEDQLNEARDKFAKALMHFGEHDSKMQPDEFFGIFDTFLQAFSEARQDLEAMRRRKEEEERRARMEAMLKEQRERERWQRQRKVLAAGSSLEEGGEFDDLVSALRSGEVFDKDLCKLKRSRKRSGSQALEVTRERAINRLNY

SEQ ID NO: 24930 - protein, 695 aa, Homo sapiens
  Payload ID: 4924
  Gene Symbol: DVL1
  Gene Name: dishevelled segment polarity protein 1
  Uniprot ID: O14640
  ENSP ID: ENSP00000368166
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 24931 - protein, 670 aa, Homo sapiens
  Payload ID: 4924
  Gene Symbol: DVL1
  Gene Name: dishevelled segment polarity protein 1
  Uniprot ID: O14640
  ENSP ID: ENSP00000368169
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKHKRRRRKQRLRQADRASSFSSITDSTMSLNIVTVTLNMERHHFLGISIVGQSNDRGDGGIYIGSIMKGGAVAADGRIEPGDMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 24932 - protein, 444 aa, Homo sapiens
  Payload ID: 4924
  Gene Symbol: DVL1
  Gene Name: dishevelled segment polarity protein 1
  ENSP ID: ENSP00000480077
MAETKIIYHMDEEETPYLVKLPVAPERVTLADFKNVLSNRPVHAYKFFFKSMDQDFGVVKEEIFDDNAKLPCFNGRVVSWLVLAEGAHSDAGSQGTDSHTDLPPPLERTGGIGDSRPPSFHPNVASSRDGMDNETGTESMVSHRRERARRRNREEAARTNGHPRGDRRRDVGLPPDSASTALSSELESSSFVDSDEDGSTSRLSSSTEQSTSSRLIRKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEGSKSSGSTRSSRRAPGREKERRAAGAGGSGSESDHTAPSGVGSSWRERPAGQLSRGSSPRSQASATAPGLPPPHPTTKAYTVVGGPPGGPPVRELAAVPPELTGSRQSFQKAMGNPCEFFVDIM

SEQ ID NO: 24933 - protein, 251 aa, Homo sapiens
  Payload ID: 4924
  Gene Symbol: DVL1
  Gene Name: dishevelled segment polarity protein 1
  ENSP ID: ENSP00000488181
DMLLQVNDVNFENMSNDDAVRVLREIVSQTGPISLTVAKCWDPTPRSYFTVPRADPVRPIDPAAWLSHTAALTGALPRYELEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEALD

SEQ ID NO: 24934 - protein, 217 aa, Homo sapiens
  Payload ID: 4924
  Gene Symbol: DVL1
  Gene Name: dishevelled segment polarity protein 1
  ENSP ID: ENSP00000488888
IDPAAWLSHTAALTGALPRYGTSPCSSAVTRTSSSSLTSSVPGAPQLEEAPLTVKSDMSAVVRVMQLPDSGLEIRDRMWLKITIANAVIGADVVDWLYTHVEGFKERREARKYASSLLKHGFLRHTVNKITFSEQCYYVFGDLCSNLATLNLNSGSSGTSDQDTLAPLPHPAAPWPLGQGYPYQYPGPPPCFPPAYQDPGFSYGSGSTGSQQSEALD

SEQ ID NO: 24935 - protein, 736 aa, Homo sapiens
  Payload ID: 4925
  Gene Symbol: DVL2
  Gene Name: dishevelled segment polarity protein 2
  Uniprot ID: O14641
  ENSP ID: ENSP00000005340
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 24936 - protein, 291 aa, Homo sapiens
  Payload ID: 4925
  Gene Symbol: DVL2
  Gene Name: dishevelled segment polarity protein 2
  ENSP ID: ENSP00000458209
MLRVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSTGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDP

SEQ ID NO: 24937 - protein, 300 aa, Homo sapiens
  Payload ID: 4925
  Gene Symbol: DVL2
  Gene Name: dishevelled segment polarity protein 2
  ENSP ID: ENSP00000458465
  MOD_RES (1)..(1): Any amino acid
XNFENMSNDDAVRVLRDIVHKPGPIVLTVAKCWDPSPQAYFTLPRTYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPP

SEQ ID NO: 24938 - protein, 730 aa, Homo sapiens
  Payload ID: 4925
  Gene Symbol: DVL2
  Gene Name: dishevelled segment polarity protein 2
  ENSP ID: ENSP00000459797
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 24939 - protein, 363 aa, Homo sapiens
  Payload ID: 4925
  Gene Symbol: DVL2
  Gene Name: dishevelled segment polarity protein 2
  ENSP ID: ENSP00000459991
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSTGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPR

SEQ ID NO: 24940 - protein, 716 aa, Homo sapiens
  Payload ID: 4926
  Gene Symbol: DVL3
  Gene Name: dishevelled segment polarity protein 3
  Uniprot ID: Q92997
  ENSP ID: ENSP00000316054
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 24941 - protein, 220 aa, Homo sapiens
  Payload ID: 4926
  Gene Symbol: DVL3
  Gene Name: dishevelled segment polarity protein 3
  ENSP ID: ENSP00000393849
MERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREI

SEQ ID NO: 24942 - protein, 699 aa, Homo sapiens
  Payload ID: 4926
  Gene Symbol: DVL3
  Gene Name: dishevelled segment polarity protein 3
  Uniprot ID: Q92997
  ENSP ID: ENSP00000405885
MGETKIIYHLDGQETPYLVKLPLPAERVTLADFKGVLQRPSYKFFFKSMDDDFGVVKEEISDDNAKLPCFNGRVVSWLVSAEGSHPDPAPFCADNPSELPPPMERTGGIGDSRPPSFHPHAGGGSQENLDNDTETDSLVSAQRERPRRRDGPEHATRLNGTAKGERRREPGGYDSSSTLMSSELETTSFFDSDEDDSTSRFSSSTEQSSASRLMRRHKRRRRKQKVSRIERSSSFSSITDSTMSLNIITVTLNMEKYNFLGISIVGQSNERGDGGIYIGSIMKGGAVAADGRIEPGDMLLQVNEINFENMSNDDAVRVLREIVHKPGPITLTVAKCWDPSPRGCFTLPRTMTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRGPRERAPSERSGPAASEHSHRSHHSLASSLRSHHTHPSYGPPGVPPLYGPPMLMMPPPPAAMGPPGAPPGRDLASVPPELTASRQSFRMAMGNPSEFFVDVM

SEQ ID NO: 24943 - protein, 77 aa, Homo sapiens
  Payload ID: 4926
  Gene Symbol: DVL3
  Gene Name: dishevelled segment polarity protein 3
  ENSP ID: ENSP00000412345
MGETKIIYHLDGQETPYLVKLPLPAERVTLADFKGVLQRPSYKFFFKSMDDDFGCLPSPLWAVVGVVTGTESLTPAE

SEQ ID NO: 24944 - protein, 836 aa, Homo sapiens
  Payload ID: 4927
  Gene Symbol: DACT1
  Gene Name: dishevelled-binding antagonist of beta-catenin 1
  Uniprot ID: Q9NYF0
  ENSP ID: ENSP00000337439
MKPSPAGTAKELEPPAPARGEQRTAEPEGRWREKGEADTERQRTRERQEATLAGLAELEYLRQRQELLVRGALRGAGGAGAAAPRAGELLGEAAQRSRLEEKFLEENILLLRKQLNCLRRRDAGLLNQLQELDKQISDLRLDVEKTSEEHLETDSRPSSGFYELSDGASGSLSNSSNSVFSECLSSCHSSTCFCSPLEATLSLSDGCPKSADLIGLLEYKEGHCEDQASGAVCRSLSTPQFNSLDVIADVNPKYQCDLVSKNGNDVYRYPSPLHAVAVQSPMFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHARCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 24945 - protein, 799 aa, Homo sapiens
  Payload ID: 4927
  Gene Symbol: DACT1
  Gene Name: dishevelled-binding antagonist of beta-catenin 1
  Uniprot ID: Q9NYF0
  ENSP ID: ENSP00000378582
MKPSPAGTAKELEPPAPARGEQRTAEPEGRWREKGEADTERQRTRERQEATLAGLAELEYLRQRQELLVRGALRGAGGAGAAAPRAGELLGEAAQRSRLEEKFLEENILLLRKQLNCLRRRDAGLLNQLQELDKQISDLRLDVEKTSEEHLETDSRPSSGFYELSDGASGSLSNSSNSVFSECLSSCHSSTCFCSPLEATLSLSDGCPKSADVNPKYQCDLVSKNGNDVYRYPSPLHAVAVQSPMFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHARCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 24946 - protein, 130 aa, Homo sapiens
  Payload ID: 4927
  Gene Symbol: DACT1
  Gene Name: dishevelled-binding antagonist of beta-catenin 1
  ENSP ID: ENSP00000404297
MFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNG

SEQ ID NO: 24947 - protein, 555 aa, Homo sapiens
  Payload ID: 4927
  Gene Symbol: DACT1
  Gene Name: dishevelled-binding antagonist of beta-catenin 1
  ENSP ID: ENSP00000442850
MFLLCLTGNPLREEDRLGNHASDICGGSELDAVKTDSSLPSPSSLWSASHPSSSKKMDGYILSLVQKKTHPVRTNKPRTSVNADPTKGLLRNGSVCVRAPGGVSQGNSVNLKNSKQACLPSGGIPSLNNGTFSPPKQWSKESKAEQAESKRVPLPEGCPSGAASDLQSKHLPKTAKPASQEHARCSAIGTGESPKESAQLSGASPKESPSRGPAPPQENKVVQPLKKMSQKNSLQGVPPATPPLLSTAFPVEERPALDFKSEGSSQSLEEAHLVKAQFIPGQQPSVRLHRGHRNMGVVKNSSLKHRGPALQGLENGLPTVREKTRAGSKKCRFPDDLDTNKKLKKASSKGRKSGGGPEAGVPGRPAGGGHRAGSRAHGHGREAVVAKPKHKRTDYRRWKSSAEISYEEALRRARRGRRENVGLYPAPVPLPYASPYAYVASDSEYSAECESLFHSTVVDTSEDEQSNYTTNCFGDSESSVSEGEFVGESTTTSDSEESGGLIWSQFVQTLPIQTVTAPDLHNHPAKTFVKIKASHNLKKKILRFRSGSLKLMTTV

SEQ ID NO: 24948 - protein, 555 aa, Homo sapiens; identical to SEQ ID NO: 24947
  Payload ID: 4927
  Gene Symbol: DACT1
  Gene Name: dishevelled-binding antagonist of beta-catenin 1
  ENSP ID: ENSP00000451598

SEQ ID NO: 24949 - protein, 774 aa, Homo sapiens
  Payload ID: 4928
  Gene Symbol: DACT2
  Gene Name: dishevelled-binding antagonist of beta-catenin 2
  Uniprot ID: Q5SW24
  ENSP ID: ENSP00000355760
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQRQGGWSTDGGGRLLVFAPGREDEGGPAQSRGAGRGGPQQQGYMPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 24950 - protein, 280 aa, Homo sapiens
  Payload ID: 4928
  Gene Symbol: DACT2
  Gene Name: dishevelled-binding antagonist of beta-catenin 2
  Uniprot ID: Q5SW24
  ENSP ID: ENSP00000355761
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTELCNAPGELDMHAPPAGCTSSSLTGVGSGLRGKCGLCGCQLPFCSVNTSSKTKSSGISRQQ

SEQ ID NO: 24951 - protein, 366 aa, Homo sapiens
  Payload ID: 4928
  Gene Symbol: DACT2
  Gene Name: dishevelled-binding antagonist of beta-catenin 2
  Uniprot ID: Q5SW24
  ENSP ID: ENSP00000476434
MPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 24952 - protein, 604 aa, Homo sapiens
  Payload ID: 4928
  Gene Symbol: DACT2
  Gene Name: dishevelled-binding antagonist of beta-catenin 2
  Uniprot ID: Q5SW24
  ENSP ID: ENSP00000476573
MGDWRPRSVDETTVPAWRPQATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQRQGGWSTDGGGRLLVFAPGREDEGGPAQSRGAGRGGPQQQGYMPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 24953 - protein, 404 aa, Homo sapiens
  Payload ID: 4929
  Gene Symbol: DACT3
  Gene Name: dishevelled-binding antagonist of beta-catenin 3
  ENSP ID: ENSP00000300875
MRSPRPCGRPPTDSPDAGGAGRPLDGYISALLRRRRRRGAGQPRTSPGGADGGPRRQNSVRQRPPDASPSPGSARPAREPSLERVGGHPTSPAALSRAWASSWESEAAPEPAAPPAAPSPPDSPAEGRLVKAQYIPGAQAATRGLPGRAARRKPPPLTRGRSVEQSPPRERPRAAGRRGRMAEASGRRGSPRARKASRSQSETSLLGRASAVPSGPPKYPTAEREEPRPPRPRRGPAPTLAAQAAGSCRRWRSTAEIDAADGRRVRPRAPAARVPGPGPSPSAPQRRLLYGCAGSDSECSAGRLGPLGRRGPAGGVGGGYGESESSASEGESPAFSSASSDSDGSGGLVWPQQLVAATAASGGGAGAGAPAGPAKVFVKIKASHALKKKILRFRSGSLKVMTTV

SEQ ID NO: 24954 - protein, 629 aa, Homo sapiens
  Payload ID: 4929
  Gene Symbol: DACT3
  Gene Name: dishevelled-binding antagonist of beta-catenin 3
  Uniprot ID: Q96B18
  ENSP ID: ENSP00000375783
MIRAFSFPVSPERGRLRGWLEGSLAGLCELHWLRERQEYRVQQALRLAQPGMGGAEAEDEEDADEDEDAAAARRAAAALEEQLEALPGLVWDLGQQLGDLSLESGGLEQESGRSSGFYEDPSSTGGPDSPPSTFCGDSGFSGSSSYGRLGPSEPRGIYASERPKSLGDASPSAPEVVGARAAVPRSFSAPYPTAGGSAGPEACSSAERRARAGPFLTPSPLHAVAMRSPRPCGRPPTDSPDAGGAGRPLDGYISALLRRRRRRGAGQPRTSPGGADGGPRRQNSVRQRPPDASPSPGSARPAREPSLERVGGHPTSPAALSRAWASSWESEAAPEPAAPPAAPSPPDSPAEGRLVKAQYIPGAQAATRGLPGRAARRKPPPLTRGRSVEQSPPRERPRAAGRRGRMAEASGRRGSPRARKASRSQSETSLLGRASAVPSGPPKYPTAEREEPRPPRPRRGPAPTLAAQAAGSCRRWRSTAEIDAADGRRVRPRAPAARVPGPGPSPSAPQRRLLYGCAGSDSECSAGRLGPLGRRGPAGGVGGGYGESESSASEGESPAFSSASSDSDGSGGLVWPQQLVAATAASGGGAGAGAPAGPAKVFVKIKASHALKKKILRFRSGSLKVMTTV

SEQ ID NO: 24955 - protein, 181 aa, Homo sapiens
  Payload ID: 4929
  Gene Symbol: DACT3
  Gene Name: dishevelled-binding antagonist of beta-catenin 3
  ENSP ID: ENSP00000387300
MIRAFSFPVSPERGRLRGWLEGSLAGLCELHWLRERQEYRVQQALRLAQPGMGGAEAEDEEDADEDEDAAAARRAAAALEEQLEALPGLVWDLGQQLGDLSLESGGLEQESGRSSGFYEDPSSTGGPDSPPSTFCGDSGFSGSSSYGRLGPSEPRGIYASERPKSLGKVGEGGALGPGKGQ

SEQ ID NO: 24956 - protein, 1524 aa, Homo sapiens
  Payload ID: 4930
  Gene Symbol: DISP1
  Gene Name: dispatched homolog 1 (Drosophila)
  Uniprot ID: Q96F81
  ENSP ID: ENSP00000284476
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPKSYAALIADWPVVVLGMCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSDRYSRVVFTSSGGETLWNLPAIKSMCNVDNSRIRSHPQFGDLCQRTTAASCCPSWTLGNYIAILNNRSSCQKIVERDVSHTLKLLRTCAKHYQNGTLGPDCWDMAARRKDQLKCTNVPRKCTKYNAVYQILHYLVDKDFMTPKTADYATPALKYSMLFSPTEKGESMMNIYLDNFENWNSSDGVTTITGIEFGIKHSLFQDYLLMDTVYPAIAIVIVLLVMCVYTKSMFITLMTMFAIISSLIVSYFLYRVVFHFEFFPFMNLTALIILVGIGADDAFVLCDVWNYTKFDKPHAETSETVSITLQHAALSMFVTSFTTAAAFYANYVSNITAIRCFGVYAGTAILVNYVLMVTWLPAVVVLHERYLLNIFTCFKKPQQQIYDNKSCWTVACQKCHKVLFAISEASRIFFEKVLPCIVIKFRYLWLFWFLALTVGGAYIVCINPKMKLPSLELSEFQVFRSSHPFERYDAEYKKLFMFERVHHGEELHMPITVIWGVSPEDNGNPLNPKSKGKLTLDSSFNIASPASQAWILHFCQKLRNQTFFYQTDEQDFTSCFIETFKQWMENQDCDEPALYPCCSHWSFPYKQEIFELCIKRAIMELERSTGYHLDSKTPGPRFDINDTIRAVVLEFQSTYLFTLAYEKMHQFYKEVDSWISSELSSAPEGLSNGWFVSNLEFYDLQDSLSDGTLIAMGLSVAVAFSVMLLTTWNIIISLYAIISIAGTIFVTVGSLVLLGWELNVLESVTISVAVGLSVDFAVHYGVAYRLAPDPDREGKVIFSLSRVGSAMAMAALTTFVAGAMMMPSTVLAYTQLGTFMMLIMCISWAFATFFFQCMCRCLGPQGTCGQIPLPKKLQCSAFSHALSTSPSDKGQSKTHTINAYHLDPRGPKSELEHEFYELEPLASHSCTAPEKTTYEETHICSEFFNSQAKNLGMPVHAAYNSELSKSTESDAGSALLQPPLEQHTVCHFFSLNQRCSCPDAYKHLNYGPHSCQQMGDCLCHQCSPTTSSFVQIQNGVAPLKATHQAVEGFVHPITHIHHCPCLQGRVKPAGMQNSLPRNFFLHPVQHIQAQEKIGKTNVHSLQRSIEEHLPKMAEPSSFVCRSTGSLLKTCCDPENKQRELCKNRDVSNLESSGGTENKAGGKVELSLSQTDASVNSEHFNQNEPKVLFNHLMGEAGCRSCPNNSQSCGRIVRVKCNSVDCQMPNMEANVPAVLTHSELSGESLLIKTL

SEQ ID NO: 24957 - protein, 1401 aa, Homo sapiens
  Payload ID: 4931
  Gene Symbol: DISP2
  Gene Name: dispatched homolog 2 (Drosophila)
  Uniprot ID: A7MBM2
  ENSP ID: ENSP00000267889
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 24958 - protein, 104 aa, Homo sapiens
  Payload ID: 4932
  Gene Symbol: DIRC1
  Gene Name: disrupted in renal carcinoma 1
  Uniprot ID: Q969H9
  ENSP ID: ENSP00000307860
MPEAHMQPAKLQTSLPTTDHGSKKPVSCYLPPLSNAHPMCIEVQNAQNCSSAAATLEPSIISDTCFYKPITKDQLSSRSELNTVRLKCLNSLRGWKILNQLSLT

SEQ ID NO: 24959 - protein, 478 aa, Homo sapiens
  Payload ID: 4933
  Gene Symbol: DIRC2
  Gene Name: disrupted in renal carcinoma 2
  Uniprot ID: Q96SL1
  ENSP ID: ENSP00000261038
MGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 24960 - protein, 115 aa, Homo sapiens
  Payload ID: 4933
  Gene Symbol: DIRC2
  Gene Name: disrupted in renal carcinoma 2
  ENSP ID: ENSP00000418554
MGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRD

SEQ ID NO: 24961 - protein, 131 aa, Homo sapiens
  Payload ID: 4934
  Gene Symbol: DIRC3
  Gene Name: disrupted in renal carcinoma 3
  ENSP ID: ENSP00000389455
MNSQNWWDFPTSCFSCRGRKMRGSTAQASGAPFLALTVLDQESVIQIIPEPLPQFYLCLLDAELTGVVRGGEDASATPRSLSHSLANCMISENGLVSRLTALETGLLCFSCKQVSPVSCRWRQNMVFKPNS

SEQ ID NO: 24962 - protein, 547 aa, Homo sapiens
  Payload ID: 4935
  Gene Symbol: DISC1
  Gene Name: disrupted in schizophrenia 1
  ENSP ID: ENSP00000295051
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRRCV

SEQ ID NO: 24963 - protein, 369 aa, Homo sapiens
  Payload ID: 4935
  Gene Symbol: DISC1
  Gene Name: disrupted in schizophrenia 1
  Uniprot ID: Q9NRI5
  ENSP ID: ENSP00000320784
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMELEPIALDPPWKPRHPEPNSY

SEQ ID NO: 24964 - protein, 382 aa, Homo sapiens
  Payload ID: 4935
  Gene Symbol: DISC1
  Gene Name: disrupted in schizophrenia 1
  ENSP ID: ENSP00000355592
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKGPAEMTPTPH

SEQ ID NO: 24965 - protein, 755 aa, Homo sapiens
  Payload ID: 4935
  Gene Symbol: DISC1
  Gene Name: disrupted in schizophrenia 1
  Uniprot ID: Q9NRI5
  ENSP ID: ENSP00000355593
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYDGVSLCRPVWSAVVRSCSLQPLPPEFKQFSCLSLRSSWDYRCPPPCLANFVFLVEMGFYHVDQTGLKLLTSSDPPSSASQSAGITDMSHCAWPLQ

SEQ ID NO: 24966 - protein, 678 aa, Homo sapiens
  Payload ID: 4935
  Gene Symbol: DISC1
  Gene Name: disrupted in schizophrenia 1
  Uniprot ID: Q9NRI5
  ENSP ID: ENSP00000355596
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYGYKYCDAESWTQRSQQLA

SEQ ID NO: 24967 - protein, 832 aa, Homo sapiens
  Payload ID: 4935
  Gene Symbol: DISC1
  Gene Name: disrupted in schizophrenia 1
  ENSP ID: ENSP00000355597
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKESYILSAELGEKCEDIGKKLLYLEDQLHTAIHSHDEDLIHSLRRELQMVKETLQAMILQLQPAKEAGEREAAASCMTAGVHEAQA

SEQ ID NO: 24968 - protein, 854 aa, Homo sapiens [sequence omitted]

SEQ ID NO: 24969 - protein, 44 aa, Homo sapiens
  Payload ID: 4935
  Gene Symbol: DISC1
  Gene Name: disrupted in schizophrenia 1
  ENSP ID: ENSP00000415147
MPGGGPQGAPAAAGGGGVSHRAAGIAYHLQRAFGGGGWHGGRAT

SEQ ID NO: 24970 - protein, 622 aa, Homo sapiens
  Payload ID: 4935
  Gene Symbol: DISC1
  Gene Name: disrupted in schizophrenia 1
  ENSP ID: ENSP00000440909
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGGHGTLWHILPDVSGGIVGAHPTFY

SEQ ID NO: 24971 - protein, 579 aa, Homo sapiens
  Payload ID: 4935
  Gene Symbol: DISC1
  Gene Name: disrupted in schizophrenia 1
  Uniprot ID: Q9NRI5
  ENSP ID: ENSP00000440953
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKETISGRLKTSPRRLDH

SEQ ID NO: 24972 - protein, 609 aa, Homo sapiens
  Payload ID: 4935
  Gene Symbol: DISC1
  Gene Name: disrupted in schizophrenia 1
  ENSP ID: ENSP00000441193
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRREVRHQTAPCRNHQLEKPVINIWAFHLRRKICLFQADGLQHGSAEVKHLKETSVEPAGSTASRKE

SEQ ID NO: 24973 - protein, 695 aa, Homo sapiens
  Payload ID: 4935
  Gene Symbol: DISC1
  Gene Name: disrupted in schizophrenia 1
  Uniprot ID: Q9NRI5
  ENSP ID: ENSP00000443996
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYAASVHCLGKCGKLTWKLVDCLSRAYSSRKPGEACL

SEQ ID NO: 24974 - protein, 356 aa, Homo sapiens
  Payload ID: 4935
  Gene Symbol: DISC1
  Gene Name: disrupted in schizophrenia 1
  Uniprot ID: Q9NRI5
  ENSP ID: ENSP00000473261
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMELRRYNKD

SEQ ID NO: 24975 - protein, 201 aa, Homo sapiens
  Payload ID: 4935
  Gene Symbol: DISC1
  Gene Name: disrupted in schizophrenia 1
  Uniprot ID: Q9NRI5
  ENSP ID: ENSP00000473386
MPGGGPQGAPAAAGGGGVSHRAAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRRKPFLDG

SEQ ID NO: 24976 - protein, 356 aa, Homo sapiens; identical to SEQ ID NO: 24974
  Payload ID: 4935
  Gene Symbol: DISC1
  Gene Name: disrupted in schizophrenia 1
  Uniprot ID: Q9NRI5
  ENSP ID: ENSP00000473417

SEQ ID NO: 24977 - protein, 662 aa, Homo sapiens
  Payload ID: 4935
  Gene Symbol: DISC1
  Gene Name: disrupted in schizophrenia 1
  Uniprot ID: Q9NRI5
  ENSP ID: ENSP00000473425
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYGR

SEQ ID NO: 24978 - protein, 356 aa, Homo sapiens; identical to SEQ ID NO: 24974
  Payload ID: 4935
  Gene Symbol: DISC1
  Gene Name: disrupted in schizophrenia 1
  Uniprot ID: Q9NRI5
  ENSP ID: ENSP00000473586

SEQ ID NO: 24979 - protein, 442 aa, Homo sapiens
  Payload ID: 4935
  Gene Symbol: DISC1
  Gene Name: disrupted in schizophrenia 1
  ENSP ID: ENSP00000481791
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQKKSKLSKQGCLCWKPKINS

SEQ ID NO: 24980 - protein, 732 aa, Homo sapiens
  Payload ID: 4935
  Gene Symbol: DISC1
  Gene Name: disrupted in schizophrenia 1
  ENSP ID: ENSP00000482174
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQHLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIHSLRRELQMVKETLQAMILQLQPAKEAGEREAAASCMTAGVHEAQA

SEQ ID NO: 24981 - protein, 559 aa, Homo sapiens
  Payload ID: 4935
  Gene Symbol: DISC1
  Gene Name: disrupted in schizophrenia 1
  Uniprot ID: Q9NRI5
  ENSP ID: ENSP00000487190
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRRNKCEGKYYEVHGNT

SEQ ID NO: 24982 - protein, 129 aa, Homo sapiens
  Payload ID: 4936
  Gene Symbol: DLX1
  Gene Name: distal-less homeobox 1
  Uniprot ID: P56177
  ENSP ID: ENSP00000341786
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGQDLVPKQAIQVQEADEAGWGGSGG

SEQ ID NO: 24983 - protein, 255 aa, Homo sapiens
  Payload ID: 4936
  Gene Symbol: DLX1
  Gene Name: distal-less homeobox 1
  Uniprot ID: P56177
  ENSP ID: ENSP00000354478
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLMKQGGAALEGSALANGRALSAGSPPVPPGWNPNSSSGKGSGGNAGSYIPSYTSWYPSAHQEAMQQPQLM

SEQ ID NO: 24984 - protein, 171 aa, Homo sapiens
  Payload ID: 4936
  Gene Symbol: DLX1
  Gene Name: distal-less homeobox 1
  ENSP ID: ENSP00000354865
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQ

SEQ ID NO: 24985 - protein, 187 aa, Homo sapiens
  Payload ID: 4936
  Gene Symbol: DLX1
  Gene Name: distal-less homeobox 1
  ENSP ID: ENSP00000448827
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLM

SEQ ID NO: 24986 - protein, 328 aa, Homo sapiens
  Payload ID: 4937
  Gene Symbol: DLX2
  Gene Name: distal-less homeobox 2
  Uniprot ID: Q07687
  ENSP ID: ENSP00000234198
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVKIWFQNRRSKFKKMWKSGEIPSEQHPGASASPPCASPPVSAPASWDFGVPQRMAGGGGPGSGGSGAGSSGSSPSSAASAFLGNYPWYHQTSGSASHLQATAPLLHPTQTPQPHHHHHHHGGGGAPVSAGTIF

SEQ ID NO: 24987 - protein, 217 aa, Homo sapiens
  Payload ID: 4937
  Gene Symbol: DLX2
  Gene Name: distal-less homeobox 2
  Uniprot ID: Q07687
  ENSP ID: ENSP00000446904
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVGLAPCRGEESAGLRWLGSRRV

SEQ ID NO: 24988 - protein, 287 aa, Homo sapiens
  Payload ID: 4938
  Gene Symbol: DLX3
  Gene Name: distal-less homeobox 3
  Uniprot ID: O60479
  ENSP ID: ENSP00000389870
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 24989 - protein, 167 aa, Homo sapiens
  Payload ID: 4938
  Gene Symbol: DLX3
  Gene Name: distal-less homeobox 3
  ENSP ID: ENSP00000449976
MVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 24990 - protein, 240 aa, Homo sapiens
  Payload ID: 4939
  Gene Symbol: DLX4
  Gene Name: distal-less homeobox 4
  Uniprot ID: Q92988
  ENSP ID: ENSP00000240306
MTSLPCPLPGRDASKAVFPDLAPVPSVAAAYPLGLSPTTAASPNLSYSRPYGHLLSYPYTEPANPGDSYLSCQQPAALSQPLCGPAEHPQELEADSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 24991 - protein, 168 aa, Homo sapiens
  Payload ID: 4939
  Gene Symbol: DLX4
  Gene Name: distal-less homeobox 4
  Uniprot ID: Q92988
  ENSP ID: ENSP00000410622
MKLSVLPPRSLLAPYTVLCCPPDSEKPRLSPEPSERRPQAPAKKLRKPRTIYSSLQLQHLNQRFQHTQYLALPERAQLAAQLGLTQTQVKIWFQNKRSKYKKLLKQNSGGQEGDFPGRTFSVSPCSPPLPSLWDLPKAGTLPTSGYGNSFGAWYQHHSSDVLASPQMM

SEQ ID NO: 24992 - protein, 114 aa, Homo sapiens
  Payload ID: 4939
  Gene Symbol: DLX4
  Gene Name: distal-less homeobox 4
  Uniprot ID: Q92988
  ENSP ID: ENSP00000480366
MKLSVLPPRSLLAPYTVLCCPPDSEKPRLSPEPSERRPQAPAKKLRKPRTIYSSLQLQHLNQRFQHTQYLALPERAQLAAQLGLTQTQVGPVSSFPISHLPWFSGNSSPSPSCE

SEQ ID NO: 24993 - protein, 289 aa, Homo sapiens
  Payload ID: 4940
  Gene Symbol: DLX5
  Gene Name: distal-less homeobox 5
  Uniprot ID: P56178
  ENSP ID: ENSP00000222598
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 24994 - protein, 191 aa, Homo sapiens
  Payload ID: 4940
  Gene Symbol: DLX5
  Gene Name: distal-less homeobox 5
  Uniprot ID: P56178
  ENSP ID: ENSP00000475008
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVNTALPCTRPA

SEQ ID NO: 24995 - protein, 293 aa, Homo sapiens
  Payload ID: 4941
  Gene Symbol: DLX6
  Gene Name: distal-less homeobox 6
  Uniprot ID: P56179
  ENSP ID: ENSP00000428480
MMTMTTMADGLEGQDSSKSAFMEFGQQQQQQQQQQQQQQQQQQQPPPPPPPPPQPHSQQSSPAMAGAHYPLHCLHSAAAAAAAGSHHHHHHQHHHHGSPYASGGGNSYNHRSLAAYPYMSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 24996 - protein, 165 aa, Homo sapiens
  Payload ID: 4941
  Gene Symbol: DLX6
  Gene Name: distal-less homeobox 6
  ENSP ID: ENSP00000451635
MAAVASRVTAPLYYLLTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 24997 - protein, 191 aa, Homo sapiens
  Payload ID: 4942
  Gene Symbol: DPRX
  Gene Name: divergent-paired related homeobox
  Uniprot ID: A6NFQ7
  ENSP ID: ENSP00000365838
MPGSEDLRKGKDQMHSHRKRTMFTKKQLEDLNILFNENPYPNPSLQKEMASKIDIHPTVLQVWFKNHRAKLKKAKCKHIHQKQETPQPPIPEGGVSTSVGLRNADTLPRLPNAAHPIGLVYTGHRVPSFQLILYPNLKVPANDFIGHRIVHFGCCRDPNIYCLYPILESQVCAPSFHSGSPACSSNQSRER

SEQ ID NO: 24998 - protein, 683 aa, Homo sapiens
  Payload ID: 4943
  Gene Symbol: DIXDC1
  Gene Name: DIX domain containing 1
  Uniprot ID: Q155Q3
  ENSP ID: ENSP00000394352
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 24999 - protein, 218 aa, Homo sapiens
  Payload ID: 4943
  Gene Symbol: DIXDC1
  Gene Name: DIX domain containing 1
  Uniprot ID: Q155Q3
  ENSP ID: ENSP00000434130
MGTQVVMRFNNSLLPTEPSQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 25000 - protein, 77 aa, Homo sapiens
  Payload ID: 4943
  Gene Symbol: DIXDC1
  Gene Name: DIX domain containing 1
  ENSP ID: ENSP00000479434
MEEAKKMISGLQALLLNGSLPEDEQERPLALCEPGVNPEEQLIIIQSRLDQSMEENQDLKKELLKCKQEARNLQGIK

SEQ ID NO: 25001 - protein, 472 aa, Homo sapiens
  Payload ID: 4943
  Gene Symbol: DIXDC1
  Gene Name: DIX domain containing 1
  Uniprot ID: Q155Q3
  ENSP ID: ENSP00000480808
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 25002 - protein, 1528 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000276297
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 25003 - protein, 498 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000321034
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAAVKSVKLEVDEDKSTKGSNFSNSEVAIGLSPYTFPQKRLFHVAGEENIT

SEQ ID NO: 25004 - protein, 1091 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000351797
MCRKKPDTMILTQIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 25005 - protein, 1125 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000422595
MGDPKAHVMARPLRAPLRRSFSDHIRDSTARALDVIWKNTRDRRLAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 25006 - protein, 463 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000425878
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAGKLTFWFCFLANLF

SEQ ID NO: 25007 - protein, 1017 aa, Homo sapiens
  Payload ID: 4944
  Gene Symbol: DLC1
  Gene Name: DLC1 Rho GTPase activating protein
  Uniprot ID: Q96QB1
  ENSP ID: ENSP00000428028
MKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 25008 - protein, 48 aa, Homo sapiens
  Payload ID: 4944
  Gene Symbol: DLC1
  Gene Name: DLC1 Rho GTPase activating protein
  ENSP ID: ENSP00000429537
MSLVPSVANGLSKGTARGGPGLKSLMSFLQNKTWSLGPQTTPTRRTAP

SEQ ID NO: 25009 - protein, 75 aa, Homo sapiens
  Payload ID: 4944
  Gene Symbol: DLC1
  Gene Name: DLC1 Rho GTPase activating protein
  ENSP ID: ENSP00000473289
  MOD_RES (1)..(1): Any amino acid
XLLQPPSCPNGMSAENGLEKSGFSQHQNKSPPKVKAEDGMQCLQLKETLATQEPTDNQVRLRKRKVRHMHRFSGF

SEQ ID NO: 25010 - protein, 122 aa, Homo sapiens
  Payload ID: 4944
  Gene Symbol: DLC1
  Gene Name: DLC1 Rho GTPase activating protein
  ENSP ID: ENSP00000488100
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLT

SEQ ID NO: 25011 - protein, 504 aa, Homo sapiens
  Payload ID: 4945
  Gene Symbol: DMRTA1
  Gene Name: DMRT-like family A1
  Uniprot ID: Q5VZB9
  ENSP ID: ENSP00000319651
MERSQCGSRDRGVSGRPHLAPGLVVAAPPPPSPALPVPSGMQVPPAFLRPPSLFLRAAAAAAAAAAATSGSGGCPPAPGLESGVGAVGCGYPRTPKCARCRNHGVVSALKGHKRFCRWRDCACAKCTLIAERQRVMAAQVALRRQQAQEESEARGLQRLLCSGLSWPPGGRASGGGGRAENPQSTGGPAAGAALGLGALRQASGSATPAFEVFQQDYPEEKQEQKESKCESCQNGQEELISKSHQLYLGSSSRSNGVIGKQSIGSSISEYSNKPDSILSPHPGEQSGGEESPRSLSSSDLESGNESEWVKDLTATKASLPTVSSRPRDPLDILTKIFPNYRRSRLEGILRFCKGDVVQAIEQVLNGKEHKPDNRNLANSEELENTAFQRASSFSLAGIGFGTLGNKSAFSPLQTTSASYGGDSSLYGVNPRVGISPLRLAYSSAGRGLSGFMSPYLTPGLVPTLPFRPALDYAFSGMIRDSSYLSSKDSITCGRLYFRPNQDNP

SEQ ID NO: 25012 - protein, 542 aa, Homo sapiens
  Payload ID: 4946
  Gene Symbol: DMRTA2
  Gene Name: DMRT-like family A2
  Uniprot ID: Q96SC8
  ENSP ID: ENSP00000383909
MELRSELPSVPGAATAAAATATGPPVASVASVAAAAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 25013 - protein, 542 aa, Homo sapiens; identical to SEQ ID NO: 25012
  Payload ID: 4946
  Gene Symbol: DMRTA2
  Gene Name: DMRT-like family A2
  Uniprot ID: Q96SC8
  ENSP ID: ENSP00000399370

SEQ ID NO: 25014 - protein, 342 aa, Homo sapiens
  Payload ID: 4947
  Gene Symbol: DMRTB1
  Gene Name: DMRT-like family B with proline-rich C-terminal, 1
  Uniprot ID: Q96MA1
  ENSP ID: ENSP00000360500
MADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 25015 - protein, 127 aa, Homo sapiens
  Payload ID: 4948
  Gene Symbol: DMRTC1
  Gene Name: DMRT-like family C1
  Uniprot ID: Q5HYR2
  ENSP ID: ENSP00000469615
MAAPPKAPIRVRNLTIRAGALTGKENNMLQPETHIFTAPEEVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 25016 - protein, 192 aa, Homo sapiens
  Payload ID: 4948
  Gene Symbol: DMRTC1
  Gene Name: DMRT-like family C1
  Uniprot ID: Q5HYR2
  ENSP ID: ENSP00000471224
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 25017 - protein, 110 aa, Homo sapiens
  Payload ID: 4948
  Gene Symbol: DMRTC1
  Gene Name: DMRT-like family C1
  ENSP ID: ENSP00000482641
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVLGK

SEQ ID NO: 25018 - protein, 138 aa, Homo sapiens
  Payload ID: 4948
  Gene Symbol: DMRTC1
  Gene Name: DMRT-like family C1
  ENSP ID: ENSP00000484718
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVPKVSDQALVSAHSEWQRKLEAAEALLTLRNS

SEQ ID NO: 25019 - protein, 192 aa, Homo sapiens; identical to SEQ ID NO: 25016
  Payload ID: 4949
  Gene Symbol: DMRTC1B
  Gene Name: DMRT-like family C1B
  Uniprot ID: Q5HYR2
  ENSP ID: ENSP00000334501

SEQ ID NO: 25020 - protein, 192 aa, Homo sapiens; identical to SEQ ID NO: 25016
  Payload ID: 4949
  Gene Symbol: DMRTC1B
  Gene Name: DMRT-like family C1B
  Uniprot ID: Q5HYR2
  ENSP ID: ENSP00000362632

SEQ ID NO: 25021 - protein, 127 aa, Homo sapiens; identical to SEQ ID NO: 25015
  Payload ID: 4949
  Gene Symbol: DMRTC1B
  Gene Name: DMRT-like family C1B
  Uniprot ID: Q5HYR2
  ENSP ID: ENSP00000362633

SEQ ID NO: 25022 - protein, 100 aa, Homo sapiens
  Payload ID: 4949
  Gene Symbol: DMRTC1B
  Gene Name: DMRT-like family C1B
  ENSP ID: ENSP00000397859
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDP

SEQ ID NO: 25023 - protein, 64 aa, Homo sapiens
  Payload ID: 4949
  Gene Symbol: DMRTC1B
  Gene Name: DMRT-like family C1B
  ENSP ID: ENSP00000404476
MAAPPKAPIRVRNLTIRAGALTGKENNMLQPETHIFTAPEEGSSQGALLLGQAPEPLSLPCTPV

SEQ ID NO: 25024 - protein, 111 aa, Homo sapiens
  Payload ID: 4949
  Gene Symbol: DMRTC1B
  Gene Name: DMRT-like family C1B
  ENSP ID: ENSP00000434020
AAPPKAPIRVRNLTIRAGALTGKENNMLQPETHIFTAPEEGSSQGALLLGQAPEPLSLPCTPVTLEQQLVSPSGDPHRAPALPSMSPKSLTRLWFLPTQSGSGSWRPLRLC

SEQ ID NO: 25025 - protein, 110 aa, Homo sapiens; identical to SEQ ID NO: 25017
  Payload ID: 4949
  Gene Symbol: DMRTC1B
  Gene Name: DMRT-like family C1B
  ENSP ID: ENSP00000435159

SEQ ID NO: 25026 - protein, 367 aa, Homo sapiens
  Payload ID: 4950
  Gene Symbol: DMRTC2
  Gene Name: DMRT-like family C2
  Uniprot ID: Q8IXT2
  ENSP ID: ENSP00000269945
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASPLSWTPVPPGPWVPGHWLPPGFSMPPPVVCRLLYQEPAVSLPPFPGFDPGTSLQLPTHGPFTTCPGSHPVLTAPLSGEPQGPPSQPRTHSTLILQPCGTPDPLQLQPQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 25027 - protein, 418 aa, Homo sapiens
  Payload ID: 4950
  Gene Symbol: DMRTC2
  Gene Name: DMRT-like family C2
  ENSP ID: ENSP00000469525
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASPLSWTPVPPGPWVPGHWLPPGFSMPPPVVCRLLYQEPAVSLPPFPGFDPGTSLQLPTHGPFTTCPGSHPVLTAPLSGEPQGPPSQPRTHSTLILQPCGTPDPLQLQPQVLGKKWDLGPWEEVEPGEGKSRKLKEAGAEEHLEGGQKRGFPVCLSPFPLQASGASCLARTSGPSEWQLQQEAAEALVGLKDSSQAPRVTPSVPPNPAWISLLHPCGPPAPAGGRGFQPVGPCLRPSPAPSVALHIGRLGSISLLS

SEQ ID NO: 25028 - protein, 161 aa, Homo sapiens
  Payload ID: 4950
  Gene Symbol: DMRTC2
  Gene Name: DMRT-like family C2
  ENSP ID: ENSP00000470553
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPP

SEQ ID NO: 25029 - protein, 224 aa, Homo sapiens
  Payload ID: 4950
  Gene Symbol: DMRTC2
  Gene Name: DMRT-like family C2
  Uniprot ID: Q8IXT2
  ENSP ID: ENSP00000472159
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKPCTQLQPVPSAPAELLWASAAQPSPGSLALVLDSGASWPLGPWTLAASRLLHATTSGVPPAVPRTCCLSASLPWL

SEQ ID NO: 25030 - protein, 134 aa, Homo sapiens
  Payload ID: 4950
  Gene Symbol: DMRTC2
  Gene Name: DMRT-like family C2
  ENSP ID: ENSP00000472215
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQ

SEQ ID NO: 25031 - protein, 165 aa, Homo sapiens
  Payload ID: 4950
  Gene Symbol: DMRTC2
  Gene Name: DMRT-like family C2
  ENSP ID: ENSP00000472488
MEPSDMPAGYHCPLDSAPWDETRDPQSTELIPRRAISRSPTCARCRNHGVTAHLKGHKRLCLFQACECHKCVLILERRRVMAAQVALRRQQEAQLKKHLMRRGEASPKAPNHFRKGTTQPQVPSGKENIAPQPQTPHGAVLLAPTPPGKNSCGPLLLSHPPEASP

SEQ ID NO: 25032 - protein, 3027 aa, Homo sapiens
  Payload ID: 4951
  Gene Symbol: DMXL1
  Gene Name: Dmx-like 1
  Uniprot ID: Q9Y485
  ENSP ID: ENSP00000309690
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLEQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYRAEKNTRMTQFFGHNFEDERWRKAALKNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNEIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPYYLTGAQDGSVRMFEWGHSQQITCFRSGGNSRVTRMRFNYQGNKFGIVDADGYLSLYQTNWKCCPVTGSMPKPYLTWQCHNKTANDFVFVSSSSLIATAGLSTDNRNVCLWDTLVAPANSLVHAFTCHDSGATVLAYAPKHQLLISGGRKGFTYVFDLCQRQQRQLFQSHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 25033 - protein, 589 aa, Homo sapiens
  Payload ID: 4951
  Gene Symbol: DMXL1
  Gene Name: Dmx-like 1
  ENSP ID: ENSP00000427692
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLK

SEQ ID NO: 25034 - protein, 3048 aa, Homo sapiens
  Payload ID: 4951
  Gene Symbol: DMXL1
  Gene Name: Dmx-like 1
  ENSP ID: ENSP00000439479
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLEQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYRAEKNTRMTQFFGHNFEDERWRKAALKNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNESLEDNSETIKNSMMEEPNINKIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPYYLTGAQDGSVRMFEWGHSQQITCFRSGGNSRVTRMRFNYQGNKFGIVDADGYLSLYQTNWKCCPVTGSMPKPYLTWQCHNKTANDFVFVSSSSLIATAGLSTDNRNVCLWDTLVAPANSLVHAFTCHDSGATVLAYAPKHQLLISGGRKGFTYVFDLCQRQQRQLFQSHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 25035 - protein, 3036 aa, Homo sapiens
  Payload ID: 4952
  Gene Symbol: DMXL2
  Gene Name: Dmx-like 2
  Uniprot ID: Q8TDJ6
  ENSP ID: ENSP00000251076
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSSRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 25036 - protein, 2400 aa, Homo sapiens
  Payload ID: 4952
  Gene Symbol: DMXL2
  Gene Name: Dmx-like 2
  Uniprot ID: Q8TDJ6
  ENSP ID: ENSP00000400855
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 25037 - protein, 3037 aa, Homo sapiens
  Payload ID: 4952
  Gene Symbol: DMXL2
  Gene Name: Dmx-like 2
  Uniprot ID: Q8TDJ6
  ENSP ID: ENSP00000441858
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSSRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 25038 - protein, 1183 aa, Homo sapiens
  Payload ID: 4952
  Gene Symbol: DMXL2
  Gene Name: Dmx-like 2
  ENSP ID: ENSP00000453267
  MOD_RES (1)..(1): Any amino acid
XINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSESIEEHVEQVNQNCIAEDCHIKVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 25039 - protein, 115 aa, Homo sapiens
  Payload ID: 4952
  Gene Symbol: DMXL2
  Gene Name: Dmx-like 2
  ENSP ID: ENSP00000453454
  MOD_RES (1)..(1): Any amino acid
XRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSG

SEQ ID NO: 25040 - protein, 76 aa, Homo sapiens
  Payload ID: 4952
  Gene Symbol: DMXL2
  Gene Name: Dmx-like 2
  ENSP ID: ENSP00000453570
GEGFLSIWQVNQTASNPKPYMSWQCHSKATSDFAFITSSSLVATSGHSNDNRFHVPRSWCHGTAVCTQTATPNLGG

SEQ ID NO: 25041 - protein, 1616 aa, Homo sapiens
  Payload ID: 4953
  Gene Symbol: DNMT1
  Gene Name: DNA (cytosine-5-)-methyltransferase 1
  Uniprot ID: P26358
  ENSP ID: ENSP00000345739
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 25042 - protein, 1632 aa, Homo sapiens
  Payload ID: 4953
  Gene Symbol: DNMT1
  Gene Name: DNA (cytosine-5-)-methyltransferase 1
  Uniprot ID: P26358
  ENSP ID: ENSP00000352516
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 25043 - protein, 1280 aa, Homo sapiens
  Payload ID: 4953
  Gene Symbol: DNMT1
  Gene Name: DNA (cytosine-5-)-methyltransferase 1
  Uniprot ID: P26358
  ENSP ID: ENSP00000440457
MARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 25044 - protein, 40 aa, Homo sapiens
  Payload ID: 4953
  Gene Symbol: DNMT1
  Gene Name: DNA (cytosine-5-)-methyltransferase 1
  ENSP ID: ENSP00000464958
MPARTAPARVPTLAVPAISLPDDVRRRLKDLERDSLTEKK

SEQ ID NO: 25045 - protein, 255 aa, Homo sapiens
  Payload ID: 4953
  Gene Symbol: DNMT1
  Gene Name: DNA (cytosine-5-)-methyltransferase 1
  ENSP ID: ENSP00000465223
MILGYRLSPFGTSPPPPRPDWGGRRRLRSSPLPIGFRAKSRGACAAAAASAEASEMPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQ

SEQ ID NO: 25046 - protein, 25 aa, Homo sapiens
  Payload ID: 4953
  Gene Symbol: DNMT1
  Gene Name: DNA (cytosine-5-)-methyltransferase 1
  ENSP ID: ENSP00000465555
MADANSPPKPLSKPRTPRRSKSDGE

SEQ ID NO: 25047 - protein, 94 aa, Homo sapiens
  Payload ID: 4953
  Gene Symbol: DNMT1
  Gene Name: DNA (cytosine-5-)-methyltransferase 1
  ENSP ID: ENSP00000465993
MADANSPPKPLSKPRTPRRSKSDGEAKRSRDPPASASQVTGIRAEPSPSPRITRKSTRQTTITSHFAKGPAKRKPQEESERAKSDESIKEEDKD

SEQ ID NO: 25048 - protein, 89 aa, Homo sapiens
  Payload ID: 4953
  Gene Symbol: DNMT1
  Gene Name: DNA (cytosine-5-)-methyltransferase 1
  ENSP ID: ENSP00000466657
MPARTAPARVPTLAVPAISLPDDVRRRLKDLERDSLTEKECVKEKLNLLHEFLQTEIKNQLCDLETKLRKEELSEICPWRTVLMLTTGK

SEQ ID NO: 25049 - protein, 119 aa, Homo sapiens
  Payload ID: 4953
  Gene Symbol: DNMT1
  Gene Name: DNA (cytosine-5-)-methyltransferase 1
  ENSP ID: ENSP00000467050
MADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEK

SEQ ID NO: 25050 - protein, 389 aa, Homo sapiens
  Payload ID: 4953
  Gene Symbol: DNMT1
  Gene Name: DNA (cytosine-5-)-methyltransferase 1
  ENSP ID: ENSP00000467125
  MOD_RES (1)..(1): Any amino acid
XCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVSGAAPAGSGQEGGFCACHQVGLGPAQSLPGGRLLAAG

SEQ ID NO: 25051 - protein, 55 aa, Homo sapiens
  Payload ID: 4953
  Gene Symbol: DNMT1
  Gene Name: DNA (cytosine-5-)-methyltransferase 1
  ENSP ID: ENSP00000467260
  MOD_RES (1)..(1): Any amino acid
XSKIVVEFLQSNSDSTYEDLINKIERTPSCDTRSLWWSRWRVMTRPGTVMSSPSS

SEQ ID NO: 25052 - protein, 77 aa, Homo sapiens
  Payload ID: 4953
  Gene Symbol: DNMT1
  Gene Name: DNA (cytosine-5-)-methyltransferase 1
  ENSP ID: ENSP00000468062
  MOD_RES (1)..(1): Any amino acid
XRRSKSDGEAKRSRDPPASASQVTGIRESCSIAQDRVQWRDLGSLQPPPPSFKRFSCLSLPTEPSPSPRITRKSTRQ

SEQ ID NO: 25053 - protein, 71 aa, Homo sapiens
  Payload ID: 4953
  Gene Symbol: DNMT1
  Gene Name: DNA (cytosine-5-)-methyltransferase 1
  ENSP ID: ENSP00000468359
MADANSPPKPLSKPRTPRRSKSDGEAKPEPSPSPRITRKSTRQTTITSHFAKGPAKRKPQEESERAKSDES

SEQ ID NO: 25054 - protein, 912 aa, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENSP ID: ENSP00000264709
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 25055 - protein, 912 aa, Homo sapiens; identical to SEQ ID NO: 25054
  Payload ID: 4954
  Gene Symbol: DNMT3A
  Gene Name: DNA (cytosine-5-)-methyltransferase 3 alpha
  Uniprot ID: Q9Y6K1
  ENSP ID: ENSP00000324375

SEQ ID NO: 25056 - protein, 723 aa, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENSP ID: ENSP00000370122
MGILERVVRRNGRVDRSLKDECDTAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 25057 - protein, 781 aa, Homo sapiens
  Payload ID: 4954
  Gene Symbol: DNMT3A
  Gene Name: DNA (cytosine-5-)-methyltransferase 3 alpha
  ENSP ID: ENSP00000370132
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLEVQNSHLY

SEQ ID NO: 25058 - protein, 689 aa, Homo sapiens
  Payload ID: 4954
  Gene Symbol: DNMT3A
  Gene Name: DNA (cytosine-5-)-methyltransferase 3 alpha
  ENSP ID: ENSP00000384237
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 25059 - protein, 166 aa, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENSP ID: ENSP00000384852
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGESSAPGAASSGPTSIP

SEQ ID NO: 25060 - protein, 845 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000201963
MEPSPEPPSLESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 25061 - protein, 833 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000313397
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 25062 - protein, 853 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000328547
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 25063 - protein, 770 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000337764
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 25064 - protein, 728 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000403169
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPASLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 25065 - protein, 694 aa, Homo sapiens
  Payload ID: 4955
  Gene Symbol: DNMT3B
  Gene Name: DNA (cytosine-5-)-methyltransferase 3 beta
  Uniprot ID: Q9UBC3
  ENSP ID: ENSP00000412305
MKGDTRHLNGEEDAGGREDSILVNGACSDQSSDSPPILEAIRTPEIRGRRSSSRLSKREVSSLLSYTQSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 25066 - protein, 387 aa, Homo sapiens
  Payload ID: 4956
  Gene Symbol: DNMT3L
  Gene Name: DNA (cytosine-5-)-methyltransferase 3-like
  Uniprot ID: Q9UJW3
  ENSP ID: ENSP00000270172
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 25067 - protein, 288 aa, Homo sapiens
  Payload ID: 4956
  Gene Symbol: DNMT3L
  Gene Name: DNA (cytosine-5-)-methyltransferase 3-like
  ENSP ID: ENSP00000400242
MAAIPALDPEAEPSMDVILVGSSELSSSVSPGTGRDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLE

SEQ ID NO: 25068 - protein, 181 aa, Homo sapiens
  Payload ID: 4956
  Gene Symbol: DNMT3L
  Gene Name: DNA (cytosine-5-)-methyltransferase 3-like
  ENSP ID: ENSP00000411608
  MOD_RES (1)..(1): Any amino acid
XAPPSGLPVCLFPTLGLPGGGGVHAPLWPQHWAGLHCCWRDRGRGIPQTQAGWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 25069 - protein, 386 aa, Homo sapiens
  Payload ID: 4956
  Gene Symbol: DNMT3L
  Gene Name: DNA (cytosine-5-)-methyltransferase 3-like
  Uniprot ID: Q9UJW3
  ENSP ID: ENSP00000486001
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 25070 - protein, 1040 aa, Homo sapiens
  Payload ID: 4957
  Gene Symbol: DCLRE1A
  Gene Name: DNA cross-link repair 1A
  Uniprot ID: Q6PJP8
  ENSP ID: ENSP00000355185
MLEDISEEDIWEYKSKRKPKRVDPNNGSKNILKSVEKATDGKYQSKRSRNRKRAAEAKEVKDHEVPLGNAGCQTSVASSQNSSCGDGIQQTQDKETTPGKLCRTQKSQHVSPKIRPVYDGYCPNCQMPFSSLIGQTPRWHVFECLDSPPRSETECPDGLLCTSTIPFHYKRYTHFLLAQSRAGDHPFSSPSPASGGSFSETKSGVLCSLEERWSSYQNQTDNSVSNDPLLMTQYFKKSPSLTEASEKISTHIQTSQQALQFTDFVENDKLVGVALRLANNSEHINLPLPENDFSDCEISYSPLQSDEDTHDIDEKPDDSQEQLFFTESSKDGSLEEDDDSCGFFKKRHGPLLKDQDESCPKVNSFLTRDKYDEGLYRFNSLNDLSQPISQNNESTLPYDLACTGGDFVLFPPALAGKLAASVHQATKAKPDEPEFHSAQSNKQKQVIEESSVYNQVSLPLVKSLMLKPFESQVEGYLSSQPTQNTIRKLSSENLNAKNNTNSACFCRKALEGVPVGKATILNTENLSSTPAPKYLKILPSGLKYNARHPSTKVMKQMDIGVYFGLPPKRKEEKLLGESALEGINLNPVPSPNQKRSSQCKRKAEKSLSDLEFDASTLHESQLSVELSSERSQRQKKRCRKSNSLQEGACQKRSDHLINTESEAVNLSKVKVFTKSAHGGLQRGNKKIPESSNVGGSRKKTCPFYKKIPGTGFTVDAFQYGVVEGCTAYFLTHFHSDHYAGLSKHFTFPVYCSEITGNLLKNKLHVQEQYIHPLPLDTECIVNGVKVVLLDANHCPGAVMILFYLPNGTVILHTGDFRADPSMERSLLADQKVHMLYLDTTYCSPEYTFPSQQEVIRFAINTAFEAVTLNPHALVVCGTYSIGKEKVFLAIADVLGSKVGMSQEKYKTLQCLNIPEINSLITTDMCSSLVHLLPMMQINFKGLQSHLKKCGGKYNQILAFRPTGWTHSNKFTRIADVIPQTKGNISIYGIPYSEHSSYLEMKRFVQWLKPQKIIPTVNVGTWKSRSTMEKYFREWKLEAGY

SEQ ID NO: 25071 - protein, 1040 aa, Homo sapiens; identical to SEQ ID NO: 25070
  Payload ID: 4957
  Gene Symbol: DCLRE1A
  Gene Name: DNA cross-link repair 1A
  Uniprot ID: Q6PJP8
  ENSP ID: ENSP00000358311

SEQ ID NO: 25072 - protein, 532 aa, Homo sapiens
  Payload ID: 4958
  Gene Symbol: DCLRE1B
  Gene Name: DNA cross-link repair 1B
  Uniprot ID: Q9H816
  ENSP ID: ENSP00000358576
MNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 25073 - protein, 577 aa, Homo sapiens
  Payload ID: 4959
  Gene Symbol: DCLRE1C
  Gene Name: DNA cross-link repair 1C
  Uniprot ID: Q96SD1
  ENSP ID: ENSP00000350349
MKHQERFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 25074 - protein, 84 aa, Homo sapiens
  Payload ID: 4959
  Gene Symbol: DCLRE1C
  Gene Name: DNA cross-link repair 1C
  ENSP ID: ENSP00000367487
MFLFQGNNGTVLYTGDFRLAQGEAARMELLHSGGRVKDIQSVYLDTTFCDPRFYQIPSREECLSGVLELVRSWITRSPYHVVWL

SEQ ID NO: 25075 - protein, 345 aa, Homo sapiens
  Payload ID: 4959
  Gene Symbol: DCLRE1C
  Gene Name: DNA cross-link repair 1C
  ENSP ID: ENSP00000367488
MDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 25076 - protein, 577 aa, Homo sapiens; identical to SEQ ID NO: 25073
  Payload ID: 4959
  Gene Symbol: DCLRE1C
  Gene Name: DNA cross-link repair 1C
  Uniprot ID: Q96SD1
  ENSP ID: ENSP00000367492

SEQ ID NO: 25077 - protein, 577 aa, Homo sapiens; identical to SEQ ID NO: 25073
  Payload ID: 4959
  Gene Symbol: DCLRE1C
  Gene Name: DNA cross-link repair 1C
  Uniprot ID: Q96SD1
  ENSP ID: ENSP00000367496

SEQ ID NO: 25078 - protein, 572 aa, Homo sapiens
  Payload ID: 4959
  Gene Symbol: DCLRE1C
  Gene Name: DNA cross-link repair 1C
  Uniprot ID: Q96SD1
  ENSP ID: ENSP00000367502
MFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 25079 - protein, 572 aa, Homo sapiens; identical to SEQ ID NO: 25078
  Payload ID: 4959
  Gene Symbol: DCLRE1C
  Gene Name: DNA cross-link repair 1C
  Uniprot ID: Q96SD1
  ENSP ID: ENSP00000367503

SEQ ID NO: 25080 - protein, 572 aa, Homo sapiens; identical to SEQ ID NO: 25078
  Payload ID: 4959
  Gene Symbol: DCLRE1C
  Gene Name: DNA cross-link repair 1C
  Uniprot ID: Q96SD1
  ENSP ID: ENSP00000367506

SEQ ID NO: 25081 - protein, 692 aa, Homo sapiens
  Payload ID: 4959
  Gene Symbol: DCLRE1C
  Gene Name: DNA cross-link repair 1C
  Uniprot ID: Q96SD1
  ENSP ID: ENSP00000367527
MSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 25082 - protein, 434 aa, Homo sapiens
  Payload ID: 4959
  Gene Symbol: DCLRE1C
  Gene Name: DNA cross-link repair 1C
  Uniprot ID: Q96SD1
  ENSP ID: ENSP00000367538
MSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSGSHSVTQARMRWCHHDSLYPLTPGIKRSSCLSLLTSWITGAYRHAQLMI

SEQ ID NO: 25083 - protein, 572 aa, Homo sapiens; identical to SEQ ID NO: 25078
  Payload ID: 4959
  Gene Symbol: DCLRE1C
  Gene Name: DNA cross-link repair 1C
  Uniprot ID: Q96SD1
  ENSP ID: ENSP00000380030

SEQ ID NO: 25084 - protein, 117 aa, Homo sapiens
  Payload ID: 4959
  Gene Symbol: DCLRE1C
  Gene Name: DNA cross-link repair 1C
  ENSP ID: ENSP00000391428
MELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEE

SEQ ID NO: 25085 - protein, 57 aa, Homo sapiens
  Payload ID: 4959
  Gene Symbol: DCLRE1C
  Gene Name: DNA cross-link repair 1C
  ENSP ID: ENSP00000413180
MKHQERFLFQGNNGTVLYTGDFRLAQGEAARMELLHSGGRVKDIQSVYLDTTFCDPR

SEQ ID NO: 25086 - protein, 998 aa, Homo sapiens
  Payload ID: 4960
  Gene Symbol: DDIAS
  Gene Name: DNA damage-induced apoptosis suppressor
  Uniprot ID: Q8IXT1
  ENSP ID: ENSP00000329930
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 25087 - protein, 225 aa, Homo sapiens
  Payload ID: 4960
  Gene Symbol: DDIAS
  Gene Name: DNA damage-induced apoptosis suppressor
  ENSP ID: ENSP00000431206
MYQMSTLKSNKVIFQLKKNNFHQFRFFKRFIWSFALVAQAEVPWCNLGSLQPPHPRPRCEHMNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQ

SEQ ID NO: 25088 - protein, 66 aa, Homo sapiens
  Payload ID: 4960
  Gene Symbol: DDIAS
  Gene Name: DNA damage-induced apoptosis suppressor
  ENSP ID: ENSP00000431234
MNRRRKFLLASVLALQNSSFIYPSCQKCFSRIILVSKRILKTNLDKVQMPVTSYSNALTTKEKPKH

SEQ ID NO: 25089 - protein, 123 aa, Homo sapiens
  Payload ID: 4960
  Gene Symbol: DDIAS
  Gene Name: DNA damage-induced apoptosis suppressor
  ENSP ID: ENSP00000432871
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVG

SEQ ID NO: 25090 - protein, 75 aa, Homo sapiens
  Payload ID: 4960
  Gene Symbol: DDIAS
  Gene Name: DNA damage-induced apoptosis suppressor
  ENSP ID: ENSP00000433306
MNRRRKFLLASVLALQNSSFIYPSCQKCFSRIILVSKRSNCPKCGSTGESGNANYRYKLSLKVAESNKLFVITVF

SEQ ID NO: 25091 - protein, 76 aa, Homo sapiens
  Payload ID: 4960
  Gene Symbol: DDIAS
  Gene Name: DNA damage-induced apoptosis suppressor
  ENSP ID: ENSP00000434427
MNRRRKFLLASVLALQNSSFIYPSCQKCFSRIILVSKRSNCPKCGSTGESGNANYRYKLSLKVAESNKLFVITVFG

SEQ ID NO: 25092 - protein, 998 aa, Homo sapiens; identical to SEQ ID NO: 25086
  Payload ID: 4960
  Gene Symbol: DDIAS
  Gene Name: DNA damage-induced apoptosis suppressor
  Uniprot ID: Q8IXT1
  ENSP ID: ENSP00000435421

SEQ ID NO: 25093 - protein, 178 aa, Homo sapiens
  Payload ID: 4960
  Gene Symbol: DDIAS
  Gene Name: DNA damage-induced apoptosis suppressor
  Uniprot ID: Q8IXT1
  ENSP ID: ENSP00000435424
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPATQDAKTK

SEQ ID NO: 25094 - protein, 120 aa, Homo sapiens
  Payload ID: 4960
  Gene Symbol: DDIAS
  Gene Name: DNA damage-induced apoptosis suppressor
  ENSP ID: ENSP00000436241
MNRRRKFLLASVLALQNSSFIYPSCQKCFSRIILVSKRSNCPKCGSTGESGNANYRYKLSLKVAESNKLFVITVFGSCLDTFFGLTATGLHRILKTNLDKVQMPVTSYSNALTTKEKPKH

SEQ ID NO: 25095 - protein, 120 aa, Homo sapiens; identical to SEQ ID NO: 25094
  Payload ID: 4960
  Gene Symbol: DDIAS
  Gene Name: DNA damage-induced apoptosis suppressor
  ENSP ID: ENSP00000436611

SEQ ID NO: 25096 - protein, 362 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000339524
MLQKPKSVKLRALRSPRKFGVAGRSCQEVLRKGCLRFQLPERGSRLCLYEDGTELTEDYFPSVPDNAELVLLTLGQAWQGCEWQGLWRMCLLLDRHLLFVPLVADVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 25097 - protein, 116 aa, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENSP ID: ENSP00000343218
MLQKPKSVKLRALRSPRKFGVAGRSCQEVLRKGCLRFQLPERGSRLCLYEDGTELTEDYFPSVPDNAELVLLTLGQAWQGSVGVRARTKTRDTSSLSPGDCQALGNGGRCGQRLFL

SEQ ID NO: 25098 - protein, 82 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000345906
MLQKPKSVKLRALRSPRKFGVAGRSCQEVLRKGCLRFQLPERGSRLCLYEDGTELTEDYFPSVPDNAELVLLTLGQAWQGCE

SEQ ID NO: 25099 - protein, 80 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000367448
MLQKPKSVKLRALRSPRKFGVAGRSCQEVLRKGCLRFQLPERGSRLCLYEDGTELTEDYFPSVPDNAELVLLTLGQAWQG

SEQ ID NO: 25100 - protein, 338 aa, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENSP ID: ENSP00000367454
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 25101 - protein, 270 aa, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENSP ID: ENSP00000436775
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIDGVLLCGPG

SEQ ID NO: 25102 - protein, 103 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000462175
MLQKPKSVKLRALRSPRKFGVAGRSCQEVLRKGCLRFQLPERGSRLCLYEDGTELTEDYFPSVPDNAELVLLTLGQAWQGWFRHVSQDSLTLLGSSCPPALVS

SEQ ID NO: 25103 - protein, 78 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000462770
  MOD_RES (1)..(1): Any amino acid
XIEKKRTIIPTLVEAIKEQDGREVDWEYFYGLLFTSENLKLVHIVCHKKTTHKLNCDPSRIYKPQTRLKRKQPVRKRQ

SEQ ID NO: 25104 - protein, 115 aa, Homo sapiens
  Payload ID: 4961
  Gene Symbol: DFFB
  Gene Name: DNA fragmentation factor, 40kDa, beta polypeptide (caspase-activated DNase)
  ENSP ID: ENSP00000463688
MLQKPKSVKLRALRSPRKFGVAGRSCQEVLRKGCLRFQLPERGSRLCLYEDGTELTEDYFPSVPDNAELVLLTLGQAWQGCEWQGLWRCERHQALPQCISRATGGAHPGRPAAAV

SEQ ID NO: 25105 - protein, 115 aa, Homo sapiens; identical to SEQ ID NO: 25104
  Payload ID: 4961
  Gene Symbol: DFFB
  Gene Name: DNA fragmentation factor, 40kDa, beta polypeptide (caspase-activated DNase)
  ENSP ID: ENSP00000463704

SEQ ID NO: 25106 - protein, 103 aa, Homo sapiens; identical to SEQ ID NO: 25102
  Payload ID: 4961
  Gene Symbol: DFFB
  Gene Name: DNA fragmentation factor, 40kDa, beta polypeptide (caspase-activated DNase)
  ENSP ID: ENSP00000486916

SEQ ID NO: 25107 - protein, 268 aa, Homo sapiens
  Payload ID: 4962
  Gene Symbol: DFFA
  Gene Name: DNA fragmentation factor, 45kDa, alpha polypeptide
  Uniprot ID: O00273
  ENSP ID: ENSP00000366235
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLEVGGNQGH

SEQ ID NO: 25108 - protein, 331 aa, Homo sapiens
  Payload ID: 4962
  Gene Symbol: DFFA
  Gene Name: DNA fragmentation factor, 45kDa, alpha polypeptide
  Uniprot ID: O00273
  ENSP ID: ENSP00000366237
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 25109 - protein, 159 aa, Homo sapiens
  Payload ID: 4962
  Gene Symbol: DFFA
  Gene Name: DNA fragmentation factor, 45kDa, alpha polypeptide
  ENSP ID: ENSP00000468395
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQSPKLPLVRRWMQ

SEQ ID NO: 25110 - protein, 340 aa, Homo sapiens
  Payload ID: 4963
  Gene Symbol: DMC1
  Gene Name: DNA meiotic recombinase 1
  Uniprot ID: Q14565
  ENSP ID: ENSP00000216024
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTFRPDRLRDIADRFNVDHDAVLDNVLYARAYTSEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 25111 - protein, 203 aa, Homo sapiens
  Payload ID: 4963
  Gene Symbol: DMC1
  Gene Name: DNA meiotic recombinase 1
  ENSP ID: ENSP00000391385
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCGEHQMELLDYVAAKFHEEAGIFKLLIIDSIMALFRVDFSGRGELAERQQKLAQMLSRLQKISE

SEQ ID NO: 25112 - protein, 138 aa, Homo sapiens
  Payload ID: 4963
  Gene Symbol: DMC1
  Gene Name: DNA meiotic recombinase 1
  ENSP ID: ENSP00000410808
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHT

SEQ ID NO: 25113 - protein, 285 aa, Homo sapiens
  Payload ID: 4963
  Gene Symbol: DMC1
  Gene Name: DNA meiotic recombinase 1
  Uniprot ID: Q14565
  ENSP ID: ENSP00000412703
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCGEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 25114 - protein, 165 aa, Homo sapiens
  Payload ID: 4963
  Gene Symbol: DMC1
  Gene Name: DNA meiotic recombinase 1
  ENSP ID: ENSP00000477737
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTL

SEQ ID NO: 25115 - protein, 467 aa, Homo sapiens
  Payload ID: 4964
  Gene Symbol: DMAP1
  Gene Name: DNA methyltransferase 1 associated protein 1
  Uniprot ID: Q9NPF5
  ENSP ID: ENSP00000312697
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKALEQMLLELGVELSPTPTEELVHMFNELRSDLVLLYELKQACANCEYELQMLRHRHEALARAGVLGGPATPASGPGPASAEPAVTEPGLGPDPKDTIIDVVGAPLTPNSRKRRESASSSSSVKKAKKP

SEQ ID NO: 25116 - protein, 467 aa, Homo sapiens; identical to SEQ ID NO: 25115
  Payload ID: 4964
  Gene Symbol: DMAP1
  Gene Name: DNA methyltransferase 1 associated protein 1
  Uniprot ID: Q9NPF5
  ENSP ID: ENSP00000354697

SEQ ID NO: 25117 - protein, 467 aa, Homo sapiens; identical to SEQ ID NO: 25115
  Payload ID: 4964
  Gene Symbol: DMAP1
  Gene Name: DNA methyltransferase 1 associated protein 1
  Uniprot ID: Q9NPF5
  ENSP ID: ENSP00000361363

SEQ ID NO: 25118 - protein, 132 aa, Homo sapiens
  Payload ID: 4964
  Gene Symbol: DMAP1
  Gene Name: DNA methyltransferase 1 associated protein 1
  ENSP ID: ENSP00000361364
IINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKEYQLYLHDDAWTKAETDHLFDLSRRFDLRF

SEQ ID NO: 25119 - protein, 151 aa, Homo sapiens
  Payload ID: 4964
  Gene Symbol: DMAP1
  Gene Name: DNA methyltransferase 1 associated protein 1
  ENSP ID: ENSP00000400269
MATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYP

SEQ ID NO: 25120 - protein, 237 aa, Homo sapiens
  Payload ID: 4964
  Gene Symbol: DMAP1
  Gene Name: DNA methyltransferase 1 associated protein 1
  ENSP ID: ENSP00000401099
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRT

SEQ ID NO: 25121 - protein, 285 aa, Homo sapiens
  Payload ID: 4964
  Gene Symbol: DMAP1
  Gene Name: DNA methyltransferase 1 associated protein 1
  ENSP ID: ENSP00000402494
MATGADVRDILELGGPEGDAASGTISKKDIINPDKKKSKKSSETLTFKRPEGMHREVYALLYSDKNKGSCLLSRMQEDLKSFAPGHDFLAIGDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKK

SEQ ID NO: 25122 - protein, 302 aa, Homo sapiens
  Payload ID: 4964
  Gene Symbol: DMAP1
  Gene Name: DNA methyltransferase 1 associated protein 1
  ENSP ID: ENSP00000409200
MATGADVRDILELGGPEGDAASGTISKKDIINPDKKKSKKSSETLTFKRPEGMHREVYALLYSDKKDAPPLLPSDTGQGYRTVKAKLGSKKVRPWKWMPFTNPARKDGAMFFHWRRAAEEGKDYPFARFNKTVQVPVYSEQEYQLYLHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKP

SEQ ID NO: 25123 - protein, 509 aa, Homo sapiens
  Payload ID: 4965
  Gene Symbol: DNTT
  Gene Name: DNA nucleotidylexotransferase
  Uniprot ID: P04053
  ENSP ID: ENSP00000360216
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 25124 - protein, 508 aa, Homo sapiens
  Payload ID: 4965
  Gene Symbol: DNTT
  Gene Name: DNA nucleotidylexotransferase
  Uniprot ID: P04053
  ENSP ID: ENSP00000486733
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIRAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRFERDLRRYATHERKMILDNHALYDKTKRIFLKAESEEEIFAHLGLDYIEPWERNA

SEQ ID NO: 25125 - protein, 393 aa, Homo sapiens
  Payload ID: 4966
  Gene Symbol: DSCC1
  Gene Name: DNA replication and sister chromatid cohesion 1
  Uniprot ID: Q9BVC3
  ENSP ID: ENSP00000322180
MKRTRDEVDATLQIAKLNAAELLPAVHCLGFGPGASGAAAGDFCLLELEPTLCQQLEDGHSLVIRGDKDEQAVLCSKDKTYDLKIADTSNMLLFIPGCKTPDQLKKEDSHCNIIHTEIFGFSNNYWELRRRRPKLKKLKKLLMENPYEGPDSQKEKDSNSSKYTTEDLLDQIQASEEEIMTQLQVLNACKIGGYWRILEFDYEMKLLNHVTQLVDSESWSFGKVPLNTCLQELGPLEPEEMIEHCLKCYGKKYVDEGEVYFELDADKICRAAARMLLQNAVKFNLAEFQEVWQQSVPEGMVTSLDQLKGLALVDRHSRPEIIFLLKVDDLPEDNQERFNSLFSLREKWTEEDIAPYIQDLCGEKQTIGALLTKYSHSSMQNGVKVYNSRRPIS

SEQ ID NO: 25126 - protein, 1060 aa, Homo sapiens
  Payload ID: 4967
  Gene Symbol: DNA2
  Gene Name: DNA replication helicase/nuclease 2
  Uniprot ID: P51530
  ENSP ID: ENSP00000351185
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 25127 - protein, 687 aa, Homo sapiens
  Payload ID: 4967
  Gene Symbol: DNA2
  Gene Name: DNA replication helicase/nuclease 2
  Uniprot ID: P51530
  ENSP ID: ENSP00000382132
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRFRRFIQLSSNLQSKKFADQSPLNP

SEQ ID NO: 25128 - protein, 687 aa, Homo sapiens; identical to SEQ ID NO: 25127
  Payload ID: 4967
  Gene Symbol: DNA2
  Gene Name: DNA replication helicase/nuclease 2
  Uniprot ID: P51530
  ENSP ID: ENSP00000382133

SEQ ID NO: 25129 - protein, 375 aa, Homo sapiens
  Payload ID: 4967
  Gene Symbol: DNA2
  Gene Name: DNA replication helicase/nuclease 2
  ENSP ID: ENSP00000389713
  MOD_RES (1)..(1): Any amino acid
XSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLISFFFCIWSHLIALL

SEQ ID NO: 25130 - protein, 39 aa, Homo sapiens
  Payload ID: 4967
  Gene Symbol: DNA2
  Gene Name: DNA replication helicase/nuclease 2
  ENSP ID: ENSP00000450014
MEQLNELELLMEKSFWEEAELPAELTGVFFCRSGRGAVA

SEQ ID NO: 25131 - protein, 867 aa, Homo sapiens
  Payload ID: 4967
  Gene Symbol: DNA2
  Gene Name: DNA replication helicase/nuclease 2
  ENSP ID: ENSP00000450393
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLISLIFHQENMKVFATYWVTFKENKTLFPLPFHTRAVSPLASAHTENSITIQNLMQYLCFKAQVYRKL

SEQ ID NO: 25132 - protein, 396 aa, Homo sapiens
  Payload ID: 4968
  Gene Symbol: DDI1
  Gene Name: DNA-damage inducible 1 homolog 1
  Uniprot ID: Q8WTU0
  ENSP ID: ENSP00000302805
MLITVYCVRRDLSEVTFSLQVSPDFELRNFKVLCEAESRVPVEEIQIIHMERLLIEDHCSLGSYGLKDGDIVVLLQKDNVGPRAPGRAPNQPRVDFSGIAVPGTSSSRPQHPGQQQQRTPAAQRSQGLASGEKVAGLQGLGSPALIRSMLLSNPHDLSLLKERNPPLAEALLSGSLETFSQVLMEQQREKALREQERLRLYTADPLDREAQAKIEEEIRQQNIEENMNIAIEEAPESFGQVTMLYINCKVNGHPLKAFVDSGAQMTIMSQACAERCNIMRLVDRRWAGVAKGVGTQRIIGRVHLAQIQIEGDFLQCSFSILEDQPMDMLLGLDMLRRHQCSIDLKKNVLVIGTTGTQTYFLPEGELPLCSRMVSGQDESSDKEITHSVMDSGRKEH

SEQ ID NO: 25133 - protein, 399 aa, Homo sapiens
  Payload ID: 4969
  Gene Symbol: DDI2
  Gene Name: DNA-damage inducible 1 homolog 2
  Uniprot ID: Q5TDH0
  ENSP ID: ENSP00000417748
MLLTVYCVRRDLSEVTFSLQVDADFELHNFRALCELESGIPAAESQIVYAERPLTDNHRSLASYGLKDGDVVILRQKENADPRPPVQFPNLPRIDFSSIAVPGTSSPRQRQPPGTQQSHSSPGEITSSPQGLDNPALLRDMLLANPHELSLLKERNPPLAEALLSGDLEKFSRVLVEQQQDRARREQERIRLFSADPFDLEAQAKIEEDIRQQNIEENMTIAMEEAPESFGQVVMLYINCKVNGHPVKAFVDSGAQMTIMSQACAERCNIMRLVDRRWAGIAKGVGTQKIIGRVHLAQVQIEGDFLPCSFSILEEQPMDMLLGLDMLKRHQCSIDLKKNVLVIGTTGSQTTFLPEGELPECARLAYGAGREDVRPEEIADQELAEALQKSAEDAERQKP

SEQ ID NO: 25134 - protein, 103 aa, Homo sapiens
  Payload ID: 4969
  Gene Symbol: DDI2
  Gene Name: DNA-damage inducible 1 homolog 2
  ENSP ID: ENSP00000448878
  MOD_RES (1)..(1): Any amino acid
XEITSSPQGLDNPALLRDMLLANPHELSLLKERNPPLAEALLSGDLEKFSRVLVEQQQDRARREQERIRLFSADPFDLEAQAKIEEDIRCPDDYHEPSLCRKV

SEQ ID NO: 25135 - protein, 99 aa, Homo sapiens
  Payload ID: 4969
  Gene Symbol: DDI2
  Gene Name: DNA-damage inducible 1 homolog 2
  ENSP ID: ENSP00000449475
QQSHSSPGEITSSPQGLDNPALLRDMLLANPHELSLLKERNPPLAEALLSGDLEKFSRVLVEQQQDRARREQERIRLFSADPFDLEAQAKIEEDIRRTP

SEQ ID NO: 25136 - protein, 238 aa, Homo sapiens
  Payload ID: 4970
  Gene Symbol: DRAM1
  Gene Name: DNA-damage regulated autophagy modulator 1
  Uniprot ID: Q8N682
  ENSP ID: ENSP00000258534
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPMIVCASLISITKLEWNPREKDYVYHVVSAICEWTVAFGFIFYFLTFIQDFQSVTLRISTEINGDI

SEQ ID NO: 25137 - protein, 128 aa, Homo sapiens
  Payload ID: 4970
  Gene Symbol: DRAM1
  Gene Name: DNA-damage regulated autophagy modulator 1
  Uniprot ID: Q8N682
  ENSP ID: ENSP00000445827
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQSVTLRISTEINGDI

SEQ ID NO: 25138 - protein, 46 aa, Homo sapiens
  Payload ID: 4970
  Gene Symbol: DRAM1
  Gene Name: DNA-damage regulated autophagy modulator 1
  ENSP ID: ENSP00000447171
  MOD_RES (1)..(1): Any amino acid
XFLRGMAFVPFLLVTWSSAAFIISYVVAVLSGHVNPFLPYISYFLR

SEQ ID NO: 25139 - protein, 53 aa, Homo sapiens
  Payload ID: 4970
  Gene Symbol: DRAM1
  Gene Name: DNA-damage regulated autophagy modulator 1
  ENSP ID: ENSP00000447906
  MOD_RES (1)..(1): Any amino acid
XHIRMVISAVSCAAVIPMIVCASLISITKLEWNPREKVIQELMATMVTHYEPH

SEQ ID NO: 25140 - protein, 114 aa, Homo sapiens
  Payload ID: 4970
  Gene Symbol: DRAM1
  Gene Name: DNA-damage regulated autophagy modulator 1
  ENSP ID: ENSP00000448075
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQ

SEQ ID NO: 25141 - protein, 266 aa, Homo sapiens
  Payload ID: 4971
  Gene Symbol: DRAM2
  Gene Name: DNA-damage regulated autophagy modulator 2
  Uniprot ID: Q6UX65
  ENSP ID: ENSP00000286692
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 25142 - protein, 266 aa, Homo sapiens; identical to SEQ ID NO: 25141
  Payload ID: 4971
  Gene Symbol: DRAM2
  Gene Name: DNA-damage regulated autophagy modulator 2
  Uniprot ID: Q6UX65
  ENSP ID: ENSP00000437718

SEQ ID NO: 25143 - protein, 66 aa, Homo sapiens
  Payload ID: 4971
  Gene Symbol: DRAM2
  Gene Name: DNA-damage regulated autophagy modulator 2
  ENSP ID: ENSP00000473779
MWWFQQGLSFLPSALVIWTSAAFIFSYITAVTLHHIDPALPYISDTGTVAPEKCLFGAMLNIAAVL

SEQ ID NO: 25144 - protein, 169 aa, Homo sapiens
  Payload ID: 4972
  Gene Symbol: DDIT3
  Gene Name: DNA-damage-inducible transcript 3
  Uniprot ID: P35638
  ENSP ID: ENSP00000340671
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 25145 - protein, 169 aa, Homo sapiens; identical to SEQ ID NO: 25144
  Payload ID: 4972
  Gene Symbol: DDIT3
  Gene Name: DNA-damage-inducible transcript 3
  Uniprot ID: P35638
  ENSP ID: ENSP00000447188

SEQ ID NO: 25146 - protein, 145 aa, Homo sapiens
  Payload ID: 4972
  Gene Symbol: DDIT3
  Gene Name: DNA-damage-inducible transcript 3
  ENSP ID: ENSP00000447503
MELVPATPHYPADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKE

SEQ ID NO: 25147 - protein, 192 aa, Homo sapiens
  Payload ID: 4972
  Gene Symbol: DDIT3
  Gene Name: DNA-damage-inducible transcript 3
  Uniprot ID: P35638
  ENSP ID: ENSP00000447803
MELVPATPHYPADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 25148 - protein, 192 aa, Homo sapiens; identical to SEQ ID NO: 25147
  Payload ID: 4972
  Gene Symbol: DDIT3
  Gene Name: DNA-damage-inducible transcript 3
  Uniprot ID: P35638
  ENSP ID: ENSP00000448665

SEQ ID NO: 25149 - protein, 168 aa, Homo sapiens
  Payload ID: 4972
  Gene Symbol: DDIT3
  Gene Name: DNA-damage-inducible transcript 3
  ENSP ID: ENSP00000481270
MAAESLPFSSDTVSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 25150 - protein, 232 aa, Homo sapiens
  Payload ID: 4973
  Gene Symbol: DDIT4
  Gene Name: DNA-damage-inducible transcript 4
  Uniprot ID: Q9NX09
  ENSP ID: ENSP00000307305
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 25151 - protein, 193 aa, Homo sapiens
  Payload ID: 4974
  Gene Symbol: DDIT4L
  Gene Name: DNA-damage-inducible transcript 4-like
  Uniprot ID: Q96D03
  ENSP ID: ENSP00000354830
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLVKKKLYSLIGTTVIEGS

SEQ ID NO: 25152 - protein, 128 aa, Homo sapiens
  Payload ID: 4974
  Gene Symbol: DDIT4L
  Gene Name: DNA-damage-inducible transcript 4-like
  ENSP ID: ENSP00000427040
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDS

SEQ ID NO: 25153 - protein, 177 aa, Homo sapiens
  Payload ID: 4974
  Gene Symbol: DDIT4L
  Gene Name: DNA-damage-inducible transcript 4-like
  ENSP ID: ENSP00000427301
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLV

SEQ ID NO: 25154 - protein, 115 aa, Homo sapiens
  Payload ID: 4975
  Gene Symbol:
  Gene Name: DNA-directed RNA polymerase II subunit RPB11-b1 [Source:UniProtKB/Swiss-Prot Acc:Q9GZM3]
  Uniprot ID: Q9GZM3
  ENSP ID: ENSP00000418603
MNAPPAFESFLLFEGEKITINKDTKVPKACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 25155 - protein, 397 aa, Homo sapiens
  Payload ID: 4976
  Gene Symbol: DNAJA1
  Gene Name: DnaJ (Hsp40) homolog, subfamily A, member 1
  Uniprot ID: P31689
  ENSP ID: ENSP00000369127
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 25156 - protein, 412 aa, Homo sapiens
  Payload ID: 4977
  Gene Symbol: DNAJA2
  Gene Name: DnaJ (Hsp40) homolog, subfamily A, member 2
  Uniprot ID: O60884
  ENSP ID: ENSP00000314030
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 25157 - protein, 47 aa, Homo sapiens
  Payload ID: 4977
  Gene Symbol: DNAJA2
  Gene Name: DnaJ (Hsp40) homolog, subfamily A, member 2
  ENSP ID: ENSP00000460104
MANVADTKLYDILGVPPGASENELKKAYRKLAKEYHPDKNPNAGDKN

SEQ ID NO: 25158 - protein, 134 aa, Homo sapiens
  Payload ID: 4977
  Gene Symbol: DNAJA2
  Gene Name: DnaJ (Hsp40) homolog, subfamily A, member 2
  ENSP ID: ENSP00000477579
MDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKIL

SEQ ID NO: 25159 - protein, 480 aa, Homo sapiens
  Payload ID: 4978
  Gene Symbol: DNAJA3
  Gene Name: DnaJ (Hsp40) homolog, subfamily A, member 3
  Uniprot ID: Q96EY1
  ENSP ID: ENSP00000262375
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 25160 - protein, 453 aa, Homo sapiens
  Payload ID: 4978
  Gene Symbol: DNAJA3
  Gene Name: DnaJ (Hsp40) homolog, subfamily A, member 3
  Uniprot ID: Q96EY1
  ENSP ID: ENSP00000347445
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 25161 - protein, 300 aa, Homo sapiens
  Payload ID: 4978
  Gene Symbol: DNAJA3
  Gene Name: DnaJ (Hsp40) homolog, subfamily A, member 3
  Uniprot ID: Q96EY1
  ENSP ID: ENSP00000393970
MAEPQAERPRLCVFPDLLRPPSAADIETWCQPYRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGKRSTGN

SEQ ID NO: 25162 - protein, 122 aa, Homo sapiens
  Payload ID: 4978
  Gene Symbol: DNAJA3
  Gene Name: DnaJ (Hsp40) homolog, subfamily A, member 3
  ENSP ID: ENSP00000458868
MAARCSTRWLLVVVGTPRLPAISGRGARPPREGVVGAWLSRKLSVPAFASSLTSCGPRALLTLRPGVSLTGGVLLCRPGWSAMARSWLTATSASQEQNITLSFVLPPSTRVPLWPKKIIIRY

SEQ ID NO: 25163 - protein, 185 aa, Homo sapiens
  Payload ID: 4978
  Gene Symbol: DNAJA3
  Gene Name: DnaJ (Hsp40) homolog, subfamily A, member 3
  ENSP ID: ENSP00000459088
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEYFMELTFNQAAKGVNKEFTVNIMDTCERCNGKGNEPGTKVQH

SEQ ID NO: 25164 - protein, 98 aa, Homo sapiens
  Payload ID: 4978
  Gene Symbol: DNAJA3
  Gene Name: DnaJ (Hsp40) homolog, subfamily A, member 3
  ENSP ID: ENSP00000459098
MAARCSTRWLLVVVGTPRLPAISGRGARPPREGVVGAWLSRKLSVPAFASSLTSCGPRALLTLRPGVSLTGRSLASSHPLHLEISRPCLISLRNTSWS

SEQ ID NO: 25165 - protein, 77 aa, Homo sapiens
  Payload ID: 4978
  Gene Symbol: DNAJA3
  Gene Name: DnaJ (Hsp40) homolog, subfamily A, member 3
  ENSP ID: ENSP00000460358
MAARCSTRWLLVVVGTPRLPAISGRGARPPREGVVGAWLSRKLSVPAFASSLTSCGPRALLTLRPGVSLTACQEVSP

SEQ ID NO: 25166 - protein, 480 aa, Homo sapiens; identical to SEQ ID NO: 25159
  Payload ID: 4978
  Gene Symbol: DNAJA3
  Gene Name: DnaJ (Hsp40) homolog, subfamily A, member 3
  Uniprot ID: Q96EY1
  ENSP ID: ENSP00000477570

SEQ ID NO: 25167 - protein, 453 aa, Homo sapiens; identical to SEQ ID NO: 25160
  Payload ID: 4978
  Gene Symbol: DNAJA3
  Gene Name: DnaJ (Hsp40) homolog, subfamily A, member 3
  Uniprot ID: Q96EY1
  ENSP ID: ENSP00000479815

SEQ ID NO: 25168 - protein, 98 aa, Homo sapiens; identical to SEQ ID NO: 25164
  Payload ID: 4978
  Gene Symbol: DNAJA3
  Gene Name: DnaJ (Hsp40) homolog, subfamily A, member 3
  ENSP ID: ENSP00000480419

SEQ ID NO: 25169 - protein, 185 aa, Homo sapiens; identical to SEQ ID NO: 25163
  Payload ID: 4978
  Gene Symbol: DNAJA3
  Gene Name: DnaJ (Hsp40) homolog, subfamily A, member 3
  ENSP ID: ENSP00000487896

SEQ ID NO: 25170 - protein, 77 aa, Homo sapiens; identical to SEQ ID NO: 25165
  Payload ID: 4978
  Gene Symbol: DNAJA3
  Gene Name: DnaJ (Hsp40) homolog, subfamily A, member 3
  ENSP ID: ENSP00000488175

SEQ ID NO: 25171 - protein, 122 aa, Homo sapiens; identical to SEQ ID NO: 25162
  Payload ID: 4978
  Gene Symbol: DNAJA3
  Gene Name: DnaJ (Hsp40) homolog, subfamily A, member 3
  ENSP ID: ENSP00000488665

SEQ ID NO: 25172 - protein, 397 aa, Homo sapiens
  Payload ID: 4979
  Gene Symbol: DNAJA4
  Gene Name: DnaJ (Hsp40) homolog, subfamily A, member 4
  Uniprot ID: Q8WW22
  ENSP ID: ENSP00000339581
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 25173 - protein, 397 aa, Homo sapiens; identical to SEQ ID NO: 25172
  Payload ID: 4979
  Gene Symbol: DNAJA4
  Gene Name: DnaJ (Hsp40) homolog, subfamily A, member 4
  Uniprot ID: Q8WW22
  ENSP ID: ENSP00000378321

SEQ ID NO: 25174 - protein, 426 aa, Homo sapiens
  Payload ID: 4979
  Gene Symbol: DNAJA4
  Gene Name: DnaJ (Hsp40) homolog, subfamily A, member 4
  Uniprot ID: Q8WW22
  ENSP ID: ENSP00000378324
MARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 25175 - protein, 211 aa, Homo sapiens
  Payload ID: 4979
  Gene Symbol: DNAJA4
  Gene Name: DnaJ (Hsp40) homolog, subfamily A, member 4
  ENSP ID: ENSP00000395191
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEV

SEQ ID NO: 25176 - protein, 114 aa, Homo sapiens
  Payload ID: 4979
  Gene Symbol: DNAJA4
  Gene Name: DnaJ (Hsp40) homolog, subfamily A, member 4
  ENSP ID: ENSP00000407136
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRECCTPVICNS

SEQ ID NO: 25177 - protein, 370 aa, Homo sapiens
  Payload ID: 4979
  Gene Symbol: DNAJA4
  Gene Name: DnaJ (Hsp40) homolog, subfamily A, member 4
  Uniprot ID: Q8WW22
  ENSP ID: ENSP00000413499
MWESLTLDSGQISALTRFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 25178 - protein, 139 aa, Homo sapiens
  Payload ID: 4979
  Gene Symbol: DNAJA4
  Gene Name: DnaJ (Hsp40) homolog, subfamily A, member 4
  ENSP ID: ENSP00000438263
MARGGSQSWSSGESDGQPKEQTPEKPRHKMVKETQYYDILGVKPSASPEEIKKAYRKLALKYHPDKNPDEGEKGHGHLQPDISLYSYSGFSVTSDTQLIISTNHRLKMLCILETEVKSFSILFTESLLFISKEAHDPPE

SEQ ID NO: 25179 - protein, 53 aa, Homo sapiens
  Payload ID: 4979
  Gene Symbol: DNAJA4
  Gene Name: DnaJ (Hsp40) homolog, subfamily A, member 4
  ENSP ID: ENSP00000441946
MVKETQYYDILGVKPSASPEEIKKAYRKLALKYHPDKNPDEGEKARMLYTSYL

SEQ ID NO: 25180 - protein, 219 aa, Homo sapiens
  Payload ID: 4979
  Gene Symbol: DNAJA4
  Gene Name: DnaJ (Hsp40) homolog, subfamily A, member 4
  ENSP ID: ENSP00000443962
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKETRP

SEQ ID NO: 25181 - protein, 340 aa, Homo sapiens
  Payload ID: 4980
  Gene Symbol: DNAJB1
  Gene Name: DnaJ (Hsp40) homolog, subfamily B, member 1
  Uniprot ID: P25685
  ENSP ID: ENSP00000254322
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 25182 - protein, 240 aa, Homo sapiens
  Payload ID: 4980
  Gene Symbol: DNAJB1
  Gene Name: DnaJ (Hsp40) homolog, subfamily B, member 1
  Uniprot ID: P25685
  ENSP ID: ENSP00000444212
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 25183 - protein, 162 aa, Homo sapiens
  Payload ID: 4980
  Gene Symbol: DNAJB1
  Gene Name: DnaJ (Hsp40) homolog, subfamily B, member 1
  ENSP ID: ENSP00000469221
MLMCLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSN

SEQ ID NO: 25184 - protein, 116 aa, Homo sapiens
  Payload ID: 4980
  Gene Symbol: DNAJB1
  Gene Name: DnaJ (Hsp40) homolog, subfamily B, member 1
  ENSP ID: ENSP00000470063
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGT

SEQ ID NO: 25185 - protein, 107 aa, Homo sapiens
  Payload ID: 4980
  Gene Symbol: DNAJB1
  Gene Name: DnaJ (Hsp40) homolog, subfamily B, member 1
  ENSP ID: ENSP00000470460
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIE

SEQ ID NO: 25186 - protein, 116 aa, Homo sapiens; identical to SEQ ID NO: 25184
  Payload ID: 4980
  Gene Symbol: DNAJB1
  Gene Name: DnaJ (Hsp40) homolog, subfamily B, member 1
  ENSP ID: ENSP00000470596

SEQ ID NO: 25187 - protein, 183 aa, Homo sapiens
  Payload ID: 4980
  Gene Symbol: DNAJB1
  Gene Name: DnaJ (Hsp40) homolog, subfamily B, member 1
  ENSP ID: ENSP00000471073
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPV

SEQ ID NO: 25188 - protein, 79 aa, Homo sapiens
  Payload ID: 4980
  Gene Symbol: DNAJB1
  Gene Name: DnaJ (Hsp40) homolog, subfamily B, member 1
  ENSP ID: ENSP00000471603
MFAEFFGGRNPFDTFFGQRNGEEGMDIDDPFSGFPMGMGGFTNVNFGRSRSAQEPARKKQDPPVTHDLRVSLEEIYSGC

SEQ ID NO: 25189 - protein, 91 aa, Homo sapiens
  Payload ID: 4980
  Gene Symbol: DNAJB1
  Gene Name: DnaJ (Hsp40) homolog, subfamily B, member 1
  ENSP ID: ENSP00000471798
MFAEFFGGRNPFDTFFGQRNGEEGMDIDDPFSGFPMGMGGFTNVNFGRSRSAQEPARKKQDPPVTHDLRVSLEEIYSGCTKKMKISHKRLN

SEQ ID NO: 25190 - protein, 80 aa, Homo sapiens
  Payload ID: 4980
  Gene Symbol: DNAJB1
  Gene Name: DnaJ (Hsp40) homolog, subfamily B, member 1
  ENSP ID: ENSP00000472886
MFAEFFGGRNPFDTFFGQRNGEEGMDIDDPFSGFPMGMGGFTNVNFGRSRSAQEPARKKQDPPVTHDLRVSLEEIYSGCT

SEQ ID NO: 25191 - protein, 358 aa, Homo sapiens
  Payload ID: 4981
  Gene Symbol: DNAJB11
  Gene Name: DnaJ (Hsp40) homolog, subfamily B, member 11
  Uniprot ID: Q9UBS4
  ENSP ID: ENSP00000265028
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 25192 - protein, 167 aa, Homo sapiens
  Payload ID: 4981
  Gene Symbol: DNAJB11
  Gene Name: DnaJ (Hsp40) homolog, subfamily B, member 11
  ENSP ID: ENSP00000408410
  MOD_RES (1)..(1): Any amino acid
XLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKAEWFEDDVIQRKRELW

SEQ ID NO: 25193 - protein, 358 aa, Homo sapiens; identical to SEQ ID NO: 25191
  Payload ID: 4981
  Gene Symbol: DNAJB11
  Gene Name: DnaJ (Hsp40) homolog, subfamily B, member 11
  Uniprot ID: Q9UBS4
  ENSP ID: ENSP00000414398

SEQ ID NO: 25194 - protein, 75 aa, Homo sapiens
  Payload ID: 4981
  Gene Symbol: DNAJB11
  Gene Name: DnaJ (Hsp40) homolog, subfamily B, member 11
  ENSP ID: ENSP00000440189
MGVKLEIFRMIIYLTFPVAMFWVSNQAEWFEDDVIQRKRELWPPEKLQELEEFKERLRKRKRREEKLLRDAQQNS

SEQ ID NO: 25195 - protein, 409 aa, Homo sapiens
  Payload ID: 4982
  Gene Symbol: DNAJB12
  Gene Name: DnaJ (Hsp40) homolog, subfamily B, member 12
  ENSP ID: ENSP00000345575
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 25196 - protein, 409 aa, Homo sapiens; identical to SEQ ID NO: 25195
  Payload ID: 4982
  Gene Symbol: DNAJB12
  Gene Name: DnaJ (Hsp40) homolog, subfamily B, member 12
  ENSP ID: ENSP00000378363

SEQ ID NO: 25197 - protein, 375 aa, Homo sapiens
  Payload ID: 4982
  Gene Symbol: DNAJB12
  Gene Name: DnaJ (Hsp40) homolog, subfamily B, member 12
  Uniprot ID: Q9NXW2
  ENSP ID: ENSP00000403313
MESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 25198 - protein, 172 aa, Homo sapiens
  Payload ID: 4982
  Gene Symbol: DNAJB12
  Gene Name: DnaJ (Hsp40) homolog, subfamily B, member 12
  ENSP ID: ENSP00000476453
MFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSETMKSLENFW

SEQ ID NO: 25199 - protein, 276 aa, Homo sapiens
  Payload ID: 4982
  Gene Symbol: DNAJB12
  Gene Name: DnaJ (Hsp40) homolog, subfamily B, member 12
  ENSP ID: ENSP00000476941
  MOD_RES (1)..(1): Any amino acid
XAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 25200 - protein, 316 aa, Homo sapiens
  Payload ID: 4983
  Gene Symbol: DNAJB13
  Gene Name: DnaJ (Hsp40) homolog, subfamily B, member 13
  Uniprot ID: P59910
  ENSP ID: ENSP00000344431
MGQDYYSVLGITRNSEDAQIKQAYRRLALKHHPLKSNEPSSAEIFRQIAEAYDVLSDPMKRGIYDKFGEEGLKGGIPLEFGSQTPWTTGYVFHGKPEKVFHEFFGGNNPFSEFFDAEGSEVDLNFGGLQGRGVKKQDPQVERDLYLSLEDLFFGCTKKIKISRRVLNEDGYSSTIKDKILTIDVKPGWRQGTRITFEKEGDQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 25201 - protein, 141 aa, Homo sapiens
  Payload ID: 4983
  Gene Symbol: DNAJB13
  Gene Name: DnaJ (Hsp40) homolog, subfamily B, member 13
  Uniprot ID: P59910
  ENSP ID: ENSP00000438576
METSRGRNLAKVTRPTSPCHLLASPAQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 25202 - protein, 141 aa, Homo sapiens; identical to SEQ ID NO: 25201
  Payload ID: 4983
  Gene Symbol: DNAJB13
  Gene Name: DnaJ (Hsp40) homolog, subfamily B, member 13
  Uniprot ID: P59910
  ENSP ID: ENSP00000439711

SEQ ID NO: 25203 - protein, 217 aa, Homo sapiens
  Payload ID: 4983
  Gene Symbol: DNAJB13
  Gene Name: DnaJ (Hsp40) homolog, subfamily B, member 13
  ENSP ID: ENSP00000440778
  MOD_RES (1)..(1): Any amino acid
XQFLLLLSLPPAEFFDAEGSEVDLNFGGLQGRGVKKQDPQVERDLYLSLEDLFFGCTKKIKISRRVLNEDGYSSTIKDKILTIDVKPGWRQGTRITFEKEGDQGPNIIPADIIFIVKEKLHPRFRRENDNLFFVNPIPLGKALTCCTVEVRTLDDRLLNIPINDIIHPKYFKKVPGEGMPLPEDPTKKGDLFIFFDIQFPTRLTPQKKQMLRQALLT

SEQ ID NO: 25204 - protein, 45 aa, Homo sapiens
  Payload ID: 4984
  Gene Symbol: DNAJB14
  Gene Name: DnaJ (Hsp40) homolog, subfamily B, member 14
  ENSP ID: ENSP00000335249
MEGNRDEAEKCVEIAREALNAGNREKAQRFLQKAEKLYPLPSARA

SEQ ID NO: 25205 - protein, 41 aa, Homo sapiens
  Payload ID: 4984
  Gene Symbol: DNAJB14
  Gene Name: DnaJ (Hsp40) homolog, subfamily B, member 14
  ENSP ID: ENSP00000389471
FSNGRAGYSQQHQHRHSGHEREEERGDQFNYMKWKGKWKEH

SEQ ID NO: 25206 - protein, 105 aa, Homo sapiens
  Payload ID: 4984
  Gene Symbol: DNAJB14
  Gene Name: DnaJ (Hsp40) homolog, subfamily B, member 14
  ENSP ID: ENSP00000390019
  MOD_RES (1)..(1): Any amino acid
XDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLRALWILEH

SEQ ID NO: 25207 - protein, 45 aa, Homo sapiens; identical to SEQ ID NO: 25204
  Payload ID: 4984
  Gene Symbol: DNAJB14
  Gene Name: DnaJ (Hsp40) homolog, subfamily B, member 14
  ENSP ID: ENSP00000390023

SEQ ID NO: 25208 - protein, 379 aa, Homo sapiens
  Payload ID: 4984
  Gene Symbol: DNAJB14
  Gene Name: DnaJ (Hsp40) homolog, subfamily B, member 14
  Uniprot ID: Q8TBM8
  ENSP ID: ENSP00000404381
MEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKKIGNAYAVLSNPEKRKQYDLTGNEEQACNHQNNGRFNFHRGCEADITPEDLFNIFFGGGFPSGSVHSFSNGRAGYSQQHQHRHSGHEREEERGDGGFSVFIQLMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 25209 - protein, 48 aa, Homo sapiens
  Payload ID: 4984
  Gene Symbol: DNAJB14
  Gene Name: DnaJ (Hsp40) homolog, subfamily B, member 14
  ENSP ID: ENSP00000416179
  MOD_RES (1)..(1): Any amino acid
XPNCTKDSTSGSGEGGKGYTKDQVDGVLSLERKRRVVQGVVEIRKEEH

SEQ ID NO: 25210 - protein, 109 aa, Homo sapiens
  Payload ID: 4984
  Gene Symbol: DNAJB14
  Gene Name: DnaJ (Hsp40) homolog, subfamily B, member 14
  ENSP ID: ENSP00000480565
MEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLRALWILEH

SEQ ID NO: 25211 - protein, 324 aa, Homo sapiens
  Payload ID: 4985
  Gene Symbol: DNAJB2
  Gene Name: DnaJ (Hsp40) homolog, subfamily B, member 2
  Uniprot ID: P25686
  ENSP ID: ENSP00000338019
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 25212 - protein, 277 aa, Homo sapiens
  Payload ID: 4985
  Gene Symbol: DNAJB2
  Gene Name: DnaJ (Hsp40) homolog, subfamily B, member 2
  Uniprot ID: P25686
  ENSP ID: ENSP00000375936
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPADVF

SEQ ID NO: 25213 - protein, 244 aa, Homo sapiens
  Payload ID: 4985
  Gene Symbol: DNAJB2
  Gene Name: DnaJ (Hsp40) homolog, subfamily B, member 2
  ENSP ID: ENSP00000375937
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAG

SEQ ID NO: 25214 - protein, 148 aa, Homo sapiens
  Payload ID: 4985
  Gene Symbol: DNAJB2
  Gene Name: DnaJ (Hsp40) homolog, subfamily B, member 2
  ENSP ID: ENSP00000387951
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHS

SEQ ID NO: 25215 - protein, 122 aa, Homo sapiens
  Payload ID: 4985
  Gene Symbol: DNAJB2
  Gene Name: DnaJ (Hsp40) homolog, subfamily B, member 2
  ENSP ID: ENSP00000392790
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGP

SEQ ID NO: 25216 - protein, 132 aa, Homo sapiens
  Payload ID: 4985
  Gene Symbol: DNAJB2
  Gene Name: DnaJ (Hsp40) homolog, subfamily B, member 2
  ENSP ID: ENSP00000395173
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFGEWTLEASEWLNFPL

SEQ ID NO: 25217 - protein, 228 aa, Homo sapiens
  Payload ID: 4985
  Gene Symbol: DNAJB2
  Gene Name: DnaJ (Hsp40) homolog, subfamily B, member 2
  ENSP ID: ENSP00000414796
MASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVT

SEQ ID NO: 25218 - protein, 337 aa, Homo sapiens
  Payload ID: 4986
  Gene Symbol: DNAJB4
  Gene Name: DnaJ (Hsp40) homolog, subfamily B, member 4
  Uniprot ID: Q9UDY4
  ENSP ID: ENSP00000359799
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 25219 - protein, 172 aa, Homo sapiens
  Payload ID: 4986
  Gene Symbol: DNAJB4
  Gene Name: DnaJ (Hsp40) homolog, subfamily B, member 4
  ENSP ID: ENSP00000399494
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIY

SEQ ID NO: 25220 - protein, 348 aa, Homo sapiens
  Payload ID: 4987
  Gene Symbol: DNAJB5
  Gene Name: DnaJ (Hsp40) homolog, subfamily B, member 5
  Uniprot ID: O75953
  ENSP ID: ENSP00000312517
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 25221 - protein, 33 aa, Homo sapiens
  Payload ID: 4987
  Gene Symbol: DNAJB5
  Gene Name: DnaJ (Hsp40) homolog, subfamily B, member 5
  ENSP ID: ENSP00000393749
MGKDYYKILGIPSGANEDEIKKAYRKMALKYHP

SEQ ID NO: 25222 - protein, 155 aa, Homo sapiens
  Payload ID: 4987
  Gene Symbol: DNAJB5
  Gene Name: DnaJ (Hsp40) homolog, subfamily B, member 5
  ENSP ID: ENSP00000396332
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRR

SEQ ID NO: 25223 - protein, 462 aa, Homo sapiens
  Payload ID: 4987
  Gene Symbol: DNAJB5
  Gene Name: DnaJ (Hsp40) homolog, subfamily B, member 5
  Uniprot ID: O75953
  ENSP ID: ENSP00000404079
MGGAEAEPWGRAPGPAIGGRRAGDSCPGWRRRSRSRGRGQRLSHGPRRRPQLLTAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 25224 - protein, 420 aa, Homo sapiens
  Payload ID: 4987
  Gene Symbol: DNAJB5
  Gene Name: DnaJ (Hsp40) homolog, subfamily B, member 5
  Uniprot ID: O75953
  ENSP ID: ENSP00000413684
MFKRTVLSCPPPAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 25225 - protein, 105 aa, Homo sapiens
  Payload ID: 4987
  Gene Symbol: DNAJB5
  Gene Name: DnaJ (Hsp40) homolog, subfamily B, member 5
  ENSP ID: ENSP00000433640
MGKDYYKILGIPSGANEDEIKKAYRKMALKYHPDKNKEPNAEEKFKEIAEAYDVLSDPKKRGLYDQYGEEAAAPLGPSVALTQMTWMWMKMRTHLALSAVLASMG

SEQ ID NO: 25226 - protein, 205 aa, Homo sapiens
  Payload ID: 4987
  Gene Symbol: DNAJB5
  Gene Name: DnaJ (Hsp40) homolog, subfamily B, member 5
  ENSP ID: ENSP00000439217
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVR

SEQ ID NO: 25227 - protein, 348 aa, Homo sapiens; identical to SEQ ID NO: 25220
  Payload ID: 4987
  Gene Symbol: DNAJB5
  Gene Name: DnaJ (Hsp40) homolog, subfamily B, member 5
  Uniprot ID: O75953
  ENSP ID: ENSP00000441999

SEQ ID NO: 25228 - protein, 211 aa, Homo sapiens
  Payload ID: 4987
  Gene Symbol: DNAJB5
  Gene Name: DnaJ (Hsp40) homolog, subfamily B, member 5
  ENSP ID: ENSP00000445536
MYGPRAASRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMK

SEQ ID NO: 25229 - protein, 326 aa, Homo sapiens
  Payload ID: 4988
  Gene Symbol: DNAJB6
  Gene Name: DnaJ (Hsp40) homolog, subfamily B, member 6
  Uniprot ID: O75190
  ENSP ID: ENSP00000262177
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 25230 - protein, 45 aa, Homo sapiens
  Payload ID: 4988
  Gene Symbol: DNAJB6
  Gene Name: DnaJ (Hsp40) homolog, subfamily B, member 6
  ENSP ID: ENSP00000389599
MVDYYEVLGVQRHASPEDIKKAYRKLALKWHPDKNPENKEEAERK

SEQ ID NO: 25231 - protein, 66 aa, Homo sapiens
  Payload ID: 4988
  Gene Symbol: DNAJB6
  Gene Name: DnaJ (Hsp40) homolog, subfamily B, member 6
  ENSP ID: ENSP00000391690
MVDYYEVLGVQRHASPEDIKKAYRKLALKWHPDKNPENKEEAERKFKQVAEAYEVLSDAKKRDIYD

SEQ ID NO: 25232 - protein, 98 aa, Homo sapiens
  Payload ID: 4988
  Gene Symbol: DNAJB6
  Gene Name: DnaJ (Hsp40) homolog, subfamily B, member 6
  ENSP ID: ENSP00000396240
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDD

SEQ ID NO: 25233 - protein, 211 aa, Homo sapiens
  Payload ID: 4988
  Gene Symbol: DNAJB6
  Gene Name: DnaJ (Hsp40) homolog, subfamily B, member 6
  ENSP ID: ENSP00000396267
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 25234 - protein, 241 aa, Homo sapiens
  Payload ID: 4988
  Gene Symbol: DNAJB6
  Gene Name: DnaJ (Hsp40) homolog, subfamily B, member 6
  Uniprot ID: O75190
  ENSP ID: ENSP00000397556
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 25235 - protein, 228 aa, Homo sapiens
  Payload ID: 4988
  Gene Symbol: DNAJB6
  Gene Name: DnaJ (Hsp40) homolog, subfamily B, member 6
  ENSP ID: ENSP00000400665
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLT

SEQ ID NO: 25236 - protein, 125 aa, Homo sapiens
  Payload ID: 4988
  Gene Symbol: DNAJB6
  Gene Name: DnaJ (Hsp40) homolog, subfamily B, member 6
  ENSP ID: ENSP00000403407
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGN

SEQ ID NO: 25237 - protein, 145 aa, Homo sapiens
  Payload ID: 4988
  Gene Symbol: DNAJB6
  Gene Name: DnaJ (Hsp40) homolog, subfamily B, member 6
  ENSP ID: ENSP00000410643
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFS

SEQ ID NO: 25238 - protein, 129 aa, Homo sapiens
  Payload ID: 4988
  Gene Symbol: DNAJB6
  Gene Name: DnaJ (Hsp40) homolog, subfamily B, member 6
  ENSP ID: ENSP00000415201
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGQGSVWVEVLCSDR

SEQ ID NO: 25239 - protein, 334 aa, Homo sapiens
  Payload ID: 4988
  Gene Symbol: DNAJB6
  Gene Name: DnaJ (Hsp40) homolog, subfamily B, member 6
  ENSP ID: ENSP00000488263
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGVQREAAVEQAQSETSLGARGQRGHKPRLGCCVLT

SEQ ID NO: 25240 - protein, 334 aa, Homo sapiens; identical to SEQ ID NO: 25239
  Payload ID: 4988
  Gene Symbol: DNAJB6
  Gene Name: DnaJ (Hsp40) homolog, subfamily B, member 6
  ENSP ID: ENSP00000488740

SEQ ID NO: 25241 - protein, 309 aa, Homo sapiens
  Payload ID: 4989
  Gene Symbol: DNAJB7
  Gene Name: DnaJ (Hsp40) homolog, subfamily B, member 7
  Uniprot ID: Q7Z6W7
  ENSP ID: ENSP00000307197
MVDYYEVLGLQRYASPEDIKKAYHKVALKWHPDKNPENKEEAERKFKEVAEAYEVLSNDEKRDIYDKYGTEGLNGGGSHFDDECEYGFTFHKPDDVFKEIFHERDPFSFHFFEDSLEDLLNRPGSSYGNRNRDAGYFFSTASEYPIFEKFSSYDTGYTSQGSLGHEGLTSFSSLAFDNSGMDNYISVTTSDKIVNGRNINTKKIIESDQEREAEDNGELTFFLVNSVANEEGFAKECSWRTQSFNNYSPNSHSSKHVSQYTFVDNDEGGISWVTSNRDPPIFSAGVKEGGKRKKKKRKEVQKKSTKRNC

SEQ ID NO: 25242 - protein, 232 aa, Homo sapiens
  Payload ID: 4990
  Gene Symbol: DNAJB8
  Gene Name: DnaJ (Hsp40) homolog, subfamily B, member 8
  Uniprot ID: Q8NHS0
  ENSP ID: ENSP00000316053
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 25243 - protein, 232 aa, Homo sapiens; identical to SEQ ID NO: 25242
  Payload ID: 4990
  Gene Symbol: DNAJB8
  Gene Name: DnaJ (Hsp40) homolog, subfamily B, member 8
  Uniprot ID: Q8NHS0
  ENSP ID: ENSP00000417418

SEQ ID NO: 25244 - protein, 223 aa, Homo sapiens
  Payload ID: 4991
  Gene Symbol: DNAJB9
  Gene Name: DnaJ (Hsp40) homolog, subfamily B, member 9
  Uniprot ID: Q9UBS3
  ENSP ID: ENSP00000249356
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 25245 - protein, 360 aa, Homo sapiens
  Payload ID: 4992
  Gene Symbol: DNAJC25
  Gene Name: DnaJ (Hsp40) homolog, subfamily C , member 25
  Uniprot ID: Q9H1X3
  ENSP ID: ENSP00000320650
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKDEETRKDYDYMLDHPEEYYSHYYHYYSRRLAPKVDVRVVILVSVCAISVFQFFSWWNSYNKAISYLATVPKYRIQATEIAKQQGLLKKAKEKGKNKKSKEEIRDEEENIIKNIIKSKIDIKGGYQKPQICDLLLFQIILAPFHLCSYIVWYCRWIYNFNIKGKEYGEEERLYIIRKSMKMSKSQFDSLEDHQKETFLKRELWIKENYEVYKQEQEEELKKKLANDPRWKRYRRWMKNEGPGRLTFVDD

SEQ ID NO: 25246 - protein, 135 aa, Homo sapiens
  Payload ID: 4992
  Gene Symbol: DNAJC25
  Gene Name: DnaJ (Hsp40) homolog, subfamily C , member 25
  ENSP ID: ENSP00000399325
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKSSCICPRGLGVEWTPAEAPQLFL

SEQ ID NO: 25247 - protein, 141 aa, Homo sapiens
  Payload ID: 4992
  Gene Symbol: DNAJC25
  Gene Name: DnaJ (Hsp40) homolog, subfamily C , member 25
  ENSP ID: ENSP00000464086
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKILVMFQSSCICPRGLGVEWTPAEAPQLFL

SEQ ID NO: 25248 - protein, 554 aa, Homo sapiens
  Payload ID: 4993
  Gene Symbol: DNAJC1
  Gene Name: DnaJ (Hsp40) homolog, subfamily C, member 1
  Uniprot ID: Q96KC8
  ENSP ID: ENSP00000366179
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 25249 - protein, 109 aa, Homo sapiens
  Payload ID: 4993
  Gene Symbol: DNAJC1
  Gene Name: DnaJ (Hsp40) homolog, subfamily C, member 1
  ENSP ID: ENSP00000431248
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQV

SEQ ID NO: 25250 - protein, 793 aa, Homo sapiens
  Payload ID: 4994
  Gene Symbol: DNAJC10
  Gene Name: DnaJ (Hsp40) homolog, subfamily C, member 10
  Uniprot ID: Q8IXB1
  ENSP ID: ENSP00000264065
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 25251 - protein, 275 aa, Homo sapiens
  Payload ID: 4994
  Gene Symbol: DNAJC10
  Gene Name: DnaJ (Hsp40) homolog, subfamily C, member 10
  ENSP ID: ENSP00000389483
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGVSQLIGC

SEQ ID NO: 25252 - protein, 121 aa, Homo sapiens
  Payload ID: 4994
  Gene Symbol: DNAJC10
  Gene Name: DnaJ (Hsp40) homolog, subfamily C, member 10
  ENSP ID: ENSP00000400096
APVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILLLH

SEQ ID NO: 25253 - protein, 332 aa, Homo sapiens
  Payload ID: 4994
  Gene Symbol: DNAJC10
  Gene Name: DnaJ (Hsp40) homolog, subfamily C, member 10
  Uniprot ID: Q8IXB1
  ENSP ID: ENSP00000441560
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILLLH

SEQ ID NO: 25254 - protein, 747 aa, Homo sapiens
  Payload ID: 4994
  Gene Symbol: DNAJC10
  Gene Name: DnaJ (Hsp40) homolog, subfamily C, member 10
  Uniprot ID: Q8IXB1
  ENSP ID: ENSP00000479930
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 25255 - protein, 177 aa, Homo sapiens [sequence omitted]

SEQ ID NO: 25256 - protein, 507 aa, Homo sapiens
  Payload ID: 4995
  Gene Symbol: DNAJC11
  Gene Name: DnaJ (Hsp40) homolog, subfamily C, member 11
  Uniprot ID: Q9NVH1
  ENSP ID: ENSP00000294401
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 25257 - protein, 559 aa, Homo sapiens
  Payload ID: 4995
  Gene Symbol: DNAJC11
  Gene Name: DnaJ (Hsp40) homolog, subfamily C, member 11
  Uniprot ID: Q9NVH1
  ENSP ID: ENSP00000366800
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 25258 - protein, 324 aa, Homo sapiens
  Payload ID: 4995
  Gene Symbol: DNAJC11
  Gene Name: DnaJ (Hsp40) homolog, subfamily C, member 11
  ENSP ID: ENSP00000410194
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGERMTDCLIIGLIDICQRCSPQPASASCRLCCCHVTLLELYIPVPSRTTAVSSFPICFVTTNCALQFSSRGIRPGLTTVLARNLDKNTVGYLQWRWGIQSAMNTSIVRDTKTSHFT

SEQ ID NO: 25259 - protein, 332 aa, Homo sapiens
  Payload ID: 4995
  Gene Symbol: DNAJC11
  Gene Name: DnaJ (Hsp40) homolog, subfamily C, member 11
  ENSP ID: ENSP00000415871
ASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWHCSSPLLQVQRPHRNTRACAPEPSFRPFLHVPTWDAECSGARTPSTAWTSAAVKLREACLSGPGSGSHQLLLLTPRSKRRTGGG

SEQ ID NO: 25260 - protein, 198 aa, Homo sapiens
  Payload ID: 4996
  Gene Symbol: DNAJC12
  Gene Name: DnaJ (Hsp40) homolog, subfamily C, member 12
  Uniprot ID: Q9UKB3
  ENSP ID: ENSP00000225171
MDAILNYRSEDTEDYYTLLGCDELSSVEQILAEFKVRALECHPDKHPENPKAVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 25261 - protein, 107 aa, Homo sapiens
  Payload ID: 4996
  Gene Symbol: DNAJC12
  Gene Name: DnaJ (Hsp40) homolog, subfamily C, member 12
  Uniprot ID: Q9UKB3
  ENSP ID: ENSP00000343575
MDAILNYRSEDTEDYYTLLGCDELSSVEQILAEFKVRALECHPDKHPENPKAVETFQKLQKAKEILTNEESRARYDHWRRSQMSMPFQQWEALNDSVKTVGFSLGAT

SEQ ID NO: 25262 - protein, 57 aa, Homo sapiens
  Payload ID: 4996
  Gene Symbol: DNAJC12
  Gene Name: DnaJ (Hsp40) homolog, subfamily C, member 12
  ENSP ID: ENSP00000473979
MDAILNYRSEDTEDYYTLLGCDELSSVEQILAEFKVRALECHPDKHPENPKAGRPRS

SEQ ID NO: 25263 - protein, 228 aa, Homo sapiens
  Payload ID: 4996
  Gene Symbol: DNAJC12
  Gene Name: DnaJ (Hsp40) homolog, subfamily C, member 12
  ENSP ID: ENSP00000474215
MDAILNYRSEDTEDYYTLLGCDELSSVEQILAEFKVRALECHPDKHPENPKADPGVKSECLARLPASFAPISLQNEISLPRTVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 25264 - protein, 40 aa, Homo sapiens
  Payload ID: 4996
  Gene Symbol: DNAJC12
  Gene Name: DnaJ (Hsp40) homolog, subfamily C, member 12
  ENSP ID: ENSP00000474804
MDAILNYRSEDTEDYYTLLGCDELSSMEFHSCCLGWSAMA

SEQ ID NO: 25265 - protein, 2243 aa, Homo sapiens
  Payload ID: 4997
  Gene Symbol: DNAJC13
  Gene Name: DnaJ (Hsp40) homolog, subfamily C, member 13
  Uniprot ID: O75165
  ENSP ID: ENSP00000260818
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLATPPNGNFADAVFRFNANISYSGVLHAVTQDGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNGRTLFKLFQHPSMAIIKGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAKEVEKFAKEKVDLVLMHWRDRMGIAQKENINQKPVVLRKRRQRIKIEANWDLFYYRFGQDHARSNLIWNFKTREELKDTLESEMRAFNIDRELGSANVISWNHHEFEVKYECLAEEIKIGDYYLRLLLEEDENEESGSIKRSYEFFNELYHRFLLTPKVNMKCLCLQALAIVYGRCHEEIGPFTDTRYIIGMLERCTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 25266 - protein, 173 aa, Homo sapiens
  Payload ID: 4997
  Gene Symbol: DNAJC13
  Gene Name: DnaJ (Hsp40) homolog, subfamily C, member 13
  ENSP ID: ENSP00000421735
CTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRVLFFKEILWKEMKSY

SEQ ID NO: 25267 - protein, 96 aa, Homo sapiens
  Payload ID: 4997
  Gene Symbol: DNAJC13
  Gene Name: DnaJ (Hsp40) homolog, subfamily C, member 13
  ENSP ID: ENSP00000426240
  MOD_RES (1)..(1): Any amino acid
XLVPYLLKLLEGIGLENLDSPAATKAQIVKALKAMTRSLQYGEQVNEILCRSSVWSAFKDQKHDLFISESQTAGYLTGVSPSLLTGSSPLHLRSGL

SEQ ID NO: 25268 - protein, 702 aa, Homo sapiens
  Payload ID: 4998
  Gene Symbol: DNAJC14
  Gene Name: DnaJ (Hsp40) homolog, subfamily C, member 14
  Uniprot ID: Q6Y2X3
  ENSP ID: ENSP00000316240
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 25269 - protein, 702 aa, Homo sapiens; identical to SEQ ID NO: 25268
  Payload ID: 4998
  Gene Symbol: DNAJC14
  Gene Name: DnaJ (Hsp40) homolog, subfamily C, member 14
  Uniprot ID: Q6Y2X3
  ENSP ID: ENSP00000317500

SEQ ID NO: 25270 - protein, 702 aa, Homo sapiens; identical to SEQ ID NO: 25268
  Payload ID: 4998
  Gene Symbol: DNAJC14
  Gene Name: DnaJ (Hsp40) homolog, subfamily C, member 14
  Uniprot ID: Q6Y2X3
  ENSP ID: ENSP00000350223

SEQ ID NO: 25271 - protein, 79 aa, Homo sapiens
  Payload ID: 4998
  Gene Symbol: DNAJC14
  Gene Name: DnaJ (Hsp40) homolog, subfamily C, member 14
  ENSP ID: ENSP00000448876
MAQKHPGERGLYGAHHSGGASLRTLGPSVDPEIPSFSGLRDSAGTAPNGTRCLTEHSGPKHTQHPNPAHWLDPSHGPPG

SEQ ID NO: 25272 - protein, 151 aa, Homo sapiens
  Payload ID: 4998
  Gene Symbol: DNAJC14
  Gene Name: DnaJ (Hsp40) homolog, subfamily C, member 14
  ENSP ID: ENSP00000450196
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSS

SEQ ID NO: 25273 - protein, 150 aa, Homo sapiens
  Payload ID: 4999
  Gene Symbol: DNAJC15
  Gene Name: DnaJ (Hsp40) homolog, subfamily C, member 15
  Uniprot ID: Q9Y5T4
  ENSP ID: ENSP00000368523
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 25274 - protein, 595 aa, Homo sapiens
  Payload ID: 5000
  Gene Symbol: DNAJC16
  Gene Name: DnaJ (Hsp40) homolog, subfamily C, member 16
  ENSP ID: ENSP00000364998
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSRFL

SEQ ID NO: 25275 - protein, 782 aa, Homo sapiens
  Payload ID: 5000
  Gene Symbol: DNAJC16
  Gene Name: DnaJ (Hsp40) homolog, subfamily C, member 16
  Uniprot ID: Q9Y2G8
  ENSP ID: ENSP00000365007
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 25276 - protein, 655 aa, Homo sapiens
  Payload ID: 5000
  Gene Symbol: DNAJC16
  Gene Name: DnaJ (Hsp40) homolog, subfamily C, member 16
  ENSP ID: ENSP00000365009
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGKIIRW

SEQ ID NO: 25277 - protein, 595 aa, Homo sapiens; identical to SEQ ID NO: 25274
  Payload ID: 5000
  Gene Symbol: DNAJC16
  Gene Name: DnaJ (Hsp40) homolog, subfamily C, member 16
  ENSP ID: ENSP00000431886

SEQ ID NO: 25278 - protein, 97 aa, Homo sapiens
  Payload ID: 5000
  Gene Symbol: DNAJC16
  Gene Name: DnaJ (Hsp40) homolog, subfamily C, member 16
  ENSP ID: ENSP00000431982
  MOD_RES (1)..(1): Any amino acid
XDLTDELAPVFLLRWFYSASDYISDCWDSIFHNNWREMMPLLSLIFSALFILFGTVIVQAFSDSNDERESSPPEKEEAQEKTGKTEPSFTKENSRFL

SEQ ID NO: 25279 - protein, 470 aa, Homo sapiens
  Payload ID: 5000
  Gene Symbol: DNAJC16
  Gene Name: DnaJ (Hsp40) homolog, subfamily C, member 16
  Uniprot ID: Q9Y2G8
  ENSP ID: ENSP00000480224
MTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 25280 - protein, 304 aa, Homo sapiens
  Payload ID: 5001
  Gene Symbol: DNAJC17
  Gene Name: DnaJ (Hsp40) homolog, subfamily C, member 17
  Uniprot ID: Q9NVM6
  ENSP ID: ENSP00000220496
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 25281 - protein, 143 aa, Homo sapiens
  Payload ID: 5001
  Gene Symbol: DNAJC17
  Gene Name: DnaJ (Hsp40) homolog, subfamily C, member 17
  ENSP ID: ENSP00000452716
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLGRCHHSARWPVVSCGHFHSSPSPEASLPATHLKAFWLRLWAKRCS

SEQ ID NO: 25282 - protein, 131 aa, Homo sapiens
  Payload ID: 5001
  Gene Symbol: DNAJC17
  Gene Name: DnaJ (Hsp40) homolog, subfamily C, member 17
  ENSP ID: ENSP00000453298
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEVAEP

SEQ ID NO: 25283 - protein, 102 aa, Homo sapiens
  Payload ID: 5001
  Gene Symbol: DNAJC17
  Gene Name: DnaJ (Hsp40) homolog, subfamily C, member 17
  ENSP ID: ENSP00000453354
MAVTKELLQMDLYALLGIEEKAADKEIGCPSLYAHQECVEYLSSSGCRESGVLCSCLLQQPLDICSGEVEHLAGGGPSSCAGRQWLTPSMALASSIASLPGG

SEQ ID NO: 25284 - protein, 131 aa, Homo sapiens; identical to SEQ ID NO: 25282
  Payload ID: 5001
  Gene Symbol: DNAJC17
  Gene Name: DnaJ (Hsp40) homolog, subfamily C, member 17
  ENSP ID: ENSP00000454082

SEQ ID NO: 25285 - protein, 125 aa, Homo sapiens
  Payload ID: 5001
  Gene Symbol: DNAJC17
  Gene Name: DnaJ (Hsp40) homolog, subfamily C, member 17
  ENSP ID: ENSP00000473912
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDRTPERRGFPAAGGTAEAHPGADTPGA

SEQ ID NO: 25286 - protein, 131 aa, Homo sapiens; identical to SEQ ID NO: 25282
  Payload ID: 5001
  Gene Symbol: DNAJC17
  Gene Name: DnaJ (Hsp40) homolog, subfamily C, member 17
  ENSP ID: ENSP00000485700

SEQ ID NO: 25287 - protein, 358 aa, Homo sapiens
  Payload ID: 5002
  Gene Symbol: DNAJC18
  Gene Name: DnaJ (Hsp40) homolog, subfamily C, member 18
  Uniprot ID: Q9H819
  ENSP ID: ENSP00000302843
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 25288 - protein, 44 aa, Homo sapiens
  Payload ID: 5002
  Gene Symbol: DNAJC18
  Gene Name: DnaJ (Hsp40) homolog, subfamily C, member 18
  ENSP ID: ENSP00000424438
MAATLGSGERWTEGSRNAEITMKFWEFLEMLVTKSLRKLTENSP

SEQ ID NO: 25289 - protein, 181 aa, Homo sapiens
  Payload ID: 5002
  Gene Symbol: DNAJC18
  Gene Name: DnaJ (Hsp40) homolog, subfamily C, member 18
  ENSP ID: ENSP00000424572
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFG

SEQ ID NO: 25290 - protein, 121 aa, Homo sapiens
  Payload ID: 5002
  Gene Symbol: DNAJC18
  Gene Name: DnaJ (Hsp40) homolog, subfamily C, member 18
  ENSP ID: ENSP00000425192
  MOD_RES (1)..(1): Any amino acid
XRTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQRGTLLTEVLAHV

SEQ ID NO: 25291 - protein, 173 aa, Homo sapiens
  Payload ID: 5002
  Gene Symbol: DNAJC18
  Gene Name: DnaJ (Hsp40) homolog, subfamily C, member 18
  ENSP ID: ENSP00000425523
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPE

SEQ ID NO: 25292 - protein, 177 aa, Homo sapiens
  Payload ID: 5002
  Gene Symbol: DNAJC18
  Gene Name: DnaJ (Hsp40) homolog, subfamily C, member 18
  ENSP ID: ENSP00000426338
ADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQRFWHSPCFRTSAQQMSFEERILRSRKQ

SEQ ID NO: 25293 - protein, 25 aa, Homo sapiens
  Payload ID: 5002
  Gene Symbol: DNAJC18
  Gene Name: DnaJ (Hsp40) homolog, subfamily C, member 18
  ENSP ID: ENSP00000426819
MAATLGSGERWTEAYIDAVRRNKYP

SEQ ID NO: 25294 - protein, 87 aa, Homo sapiens
  Payload ID: 5002
  Gene Symbol: DNAJC18
  Gene Name: DnaJ (Hsp40) homolog, subfamily C, member 18
  ENSP ID: ENSP00000427700
MAATLGSGERWTEAYIDAVRRNKYPEDTPPESHDPCGCCNCMKAQKEKKSENEWTQTRQGEGNSTYSEEQLLGVQSNRKCICSPEQS

SEQ ID NO: 25295 - protein, 30 aa, Homo sapiens
  Payload ID: 5002
  Gene Symbol: DNAJC18
  Gene Name: DnaJ (Hsp40) homolog, subfamily C, member 18
  ENSP ID: ENSP00000485339
  MOD_RES (1)..(1): Any amino acid
XDERLKQKAESLKLENCEKLSKLIGLRRGG

SEQ ID NO: 25296 - protein, 116 aa, Homo sapiens
  Payload ID: 5003
  Gene Symbol: DNAJC19
  Gene Name: DnaJ (Hsp40) homolog, subfamily C, member 19
  Uniprot ID: Q96DA6
  ENSP ID: ENSP00000372005
MASTVVAVGLTIAAAGFAGRYVLQAMKHMEPQVKQVFQSLPKSAFSGGYYRGGFEPKMTKREAALILGVSPTANKGKIRDAHRRIMLLNHPDKGGSPYIAAKINEAKDLLEGQAKK

SEQ ID NO: 25297 - protein, 47 aa, Homo sapiens
  Payload ID: 5003
  Gene Symbol: DNAJC19
  Gene Name: DnaJ (Hsp40) homolog, subfamily C, member 19
  ENSP ID: ENSP00000418058
MASTVVAVGLTIAAAGFAGRYVLQAMKHMEPQVKQVFQSLPKSPYCQ

SEQ ID NO: 25298 - protein, 91 aa, Homo sapiens
  Payload ID: 5003
  Gene Symbol: DNAJC19
  Gene Name: DnaJ (Hsp40) homolog, subfamily C, member 19
  Uniprot ID: Q96DA6
  ENSP ID: ENSP00000419191
MKHMEPQVKQVFQSLPKSAFSGGYYRGGFEPKMTKREAALILGVSPTANKGKIRDAHRRIMLLNHPDKGGSPYIAAKINEAKDLLEGQAKK

SEQ ID NO: 25299 - protein, 59 aa, Homo sapiens
  Payload ID: 5003
  Gene Symbol: DNAJC19
  Gene Name: DnaJ (Hsp40) homolog, subfamily C, member 19
  ENSP ID: ENSP00000419991
MASTVVAVGLTIAAAGFAGRYVLQAMKHMEPQVKQVFQSLPKSAFSGGYYRALLPIKGK

SEQ ID NO: 25300 - protein, 91 aa, Homo sapiens; identical to SEQ ID NO: 25298
  Payload ID: 5003
  Gene Symbol: DNAJC19
  Gene Name: DnaJ (Hsp40) homolog, subfamily C, member 19
  Uniprot ID: Q96DA6
  ENSP ID: ENSP00000420767

SEQ ID NO: 25301 - protein, 568 aa, Homo sapiens
  Payload ID: 5004
  Gene Symbol: DNAJC2
  Gene Name: DnaJ (Hsp40) homolog, subfamily C, member 2
  Uniprot ID: Q99543
  ENSP ID: ENSP00000249270
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 25302 - protein, 167 aa, Homo sapiens
  Payload ID: 5004
  Gene Symbol: DNAJC2
  Gene Name: DnaJ (Hsp40) homolog, subfamily C, member 2
  ENSP ID: ENSP00000368559
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKGSPGDSYQKLILQLIHLMKCYLIQ

SEQ ID NO: 25303 - protein, 621 aa, Homo sapiens
  Payload ID: 5004
  Gene Symbol: DNAJC2
  Gene Name: DnaJ (Hsp40) homolog, subfamily C, member 2
  Uniprot ID: Q99543
  ENSP ID: ENSP00000368565
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 25304 - protein, 188 aa, Homo sapiens
  Payload ID: 5004
  Gene Symbol: DNAJC2
  Gene Name: DnaJ (Hsp40) homolog, subfamily C, member 2
  ENSP ID: ENSP00000399058
MLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRWSNKKNVPKLGDMNSSFEDVDIFYSFWYNFDSWREFSYLDEEEKEKAECRDERRWIEKQNRATRAQRKKEE

SEQ ID NO: 25305 - protein, 118 aa, Homo sapiens
  Payload ID: 5004
  Gene Symbol: DNAJC2
  Gene Name: DnaJ (Hsp40) homolog, subfamily C, member 2
  ENSP ID: ENSP00000406275
MLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAARKYLVILK

SEQ ID NO: 25306 - protein, 243 aa, Homo sapiens
  Payload ID: 5004
  Gene Symbol: DNAJC2
  Gene Name: DnaJ (Hsp40) homolog, subfamily C, member 2
  ENSP ID: ENSP00000412611
  MOD_RES (1)..(1): Any amino acid
XTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRYNFDSWREFSYLDEEEKEKAECRDERRWIEKQNRATRAQRKKEEMNRIRTLVDNAYSCDPRIK

SEQ ID NO: 25307 - protein, 531 aa, Homo sapiens
  Payload ID: 5005
  Gene Symbol: DNAJC21
  Gene Name: DnaJ (Hsp40) homolog, subfamily C, member 21
  Uniprot ID: Q5F1R6
  ENSP ID: ENSP00000343728
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 25308 - protein, 576 aa, Homo sapiens
  Payload ID: 5005
  Gene Symbol: DNAJC21
  Gene Name: DnaJ (Hsp40) homolog, subfamily C, member 21
  Uniprot ID: Q5F1R6
  ENSP ID: ENSP00000371451
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQDVPGKDSYLPAAHFQMAWGKKCVLGERRDGESEHKCAKMLLENRQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 25309 - protein, 341 aa, Homo sapiens
  Payload ID: 5006
  Gene Symbol: DNAJC22
  Gene Name: DnaJ (Hsp40) homolog, subfamily C, member 22
  Uniprot ID: Q8N4W6
  ENSP ID: ENSP00000378508
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 25310 - protein, 341 aa, Homo sapiens; identical to SEQ ID NO: 25309
  Payload ID: 5006
  Gene Symbol: DNAJC22
  Gene Name: DnaJ (Hsp40) homolog, subfamily C, member 22
  Uniprot ID: Q8N4W6
  ENSP ID: ENSP00000446830

SEQ ID NO: 25311 - protein, 29 aa, Homo sapiens
  Payload ID: 5007
  Gene Symbol: DNAJC24
  Gene Name: DnaJ (Hsp40) homolog, subfamily C, member 24
  ENSP ID: ENSP00000379279
  MOD_RES (1)..(1): Any amino acid
XDDLRNVGPVDAQVYLEEMSWNEVTSQRQ

SEQ ID NO: 25312 - protein, 149 aa, Homo sapiens
  Payload ID: 5007
  Gene Symbol: DNAJC24
  Gene Name: DnaJ (Hsp40) homolog, subfamily C, member 24
  ENSP ID: ENSP00000417548
MMAVEQMPKKDWYSILGADPSANISDLKQKYQKLILMYHPDKQSTDVPAGTVEECVQKFIEIDQAWKILGNEETKREYDLQRCEDDLRNVGPVDAQVYLEEMSWNEGDHSFYLSCRCGGKYSVSKDEAEEVSLISCDTCSLIIELLHYN

SEQ ID NO: 25313 - protein, 44 aa, Homo sapiens
  Payload ID: 5007
  Gene Symbol: DNAJC24
  Gene Name: DnaJ (Hsp40) homolog, subfamily C, member 24
  ENSP ID: ENSP00000432072
MMAVEQMPKKDWYSILGADPSANISDLKQKYQKLILMDLFLYVI

SEQ ID NO: 25314 - protein, 42 aa, Homo sapiens
  Payload ID: 5007
  Gene Symbol: DNAJC24
  Gene Name: DnaJ (Hsp40) homolog, subfamily C, member 24
  ENSP ID: ENSP00000432388
  MOD_RES (1)..(1): Any amino acid
XSANISDLKQKYQKLILMVIGFFPPLFGVHTWKDASVTGKFL

SEQ ID NO: 25315 - protein, 43 aa, Homo sapiens
  Payload ID: 5007
  Gene Symbol: DNAJC24
  Gene Name: DnaJ (Hsp40) homolog, subfamily C, member 24
  ENSP ID: ENSP00000434114
MAVEQMPKKDWYSILGADPSANISDLKQKYQKLILMALAGCFY

SEQ ID NO: 25316 - protein, 85 aa, Homo sapiens
  Payload ID: 5007
  Gene Symbol: DNAJC24
  Gene Name: DnaJ (Hsp40) homolog, subfamily C, member 24
  ENSP ID: ENSP00000435771
MMAVEQMPKKDWYSILGADPSANISDLKQKYQKLILMYHPDKQSTDVPAGTVEECVQKFIEIDQAWKILGNEETKREYDLQRCGS

SEQ ID NO: 25317 - protein, 273 aa, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENSP ID: ENSP00000264711
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 25318 - protein, 90 aa, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENSP ID: ENSP00000370187
MEANMPKRKEPGRSLRIKVISMGNAEVGKSCIIKRYCEKRFVSKYLATIGIDYGVTKVHVRDREIKVNIFDMAGHPFFYEMRKLRRREVK

SEQ ID NO: 25319 - protein, 177 aa, Homo sapiens
  Payload ID: 5008
  Gene Symbol: DNAJC27
  Gene Name: DnaJ (Hsp40) homolog, subfamily C, member 27
  Uniprot ID: Q9NZQ0
  ENSP ID: ENSP00000440086
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQG

SEQ ID NO: 25320 - protein, 388 aa, Homo sapiens
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000320303
MNTMYVMMAQILRSHLIKATVIPNRVKMLPYFGIIRNRMMSTHKSKKKIREYYRLLNVEEGCSADEVRESFHKLAKQYHPDSGSNTADSATFIRIEKAYRKVLSHVIEQTNASQSKGEEEEDVEKFKYKTPQHRHYLSFEGIGFGTPTQREKHYRQFRADRAAEQVMEYQKQKLQSQYFPDSVIVKNIRQSKQQKITQAIERLVEDLIQESMAKGDFDNLSGKGKPLKKFSDCSYIDPMTHNLNRILIDNGYQPEWILKQKEISDTIEQLREAILVSRKKLGNPMTPTEKKQWNHVCEQFQENIRKLNKRINDFNLIVPILTRQKVHFDAQKEIVRAQKIYETLIKTKEVTDRNPNNLDQGEGEKTPEIKKGFLNWMNLWKFIKIRSF

SEQ ID NO: 25321 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000371373

SEQ ID NO: 25322 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000385777

SEQ ID NO: 25323 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000461084

SEQ ID NO: 25324 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000461665

SEQ ID NO: 25325 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000461737

SEQ ID NO: 25326 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000479716

SEQ ID NO: 25327 - protein, 388 aa, Homo sapiens; identical to SEQ ID NO: 25320
  Payload ID: 5009
  Gene Symbol: DNAJC28
  Gene Name: DnaJ (Hsp40) homolog, subfamily C, member 28
  Uniprot ID: Q9NX36
  ENSP ID: ENSP00000483670

SEQ ID NO: 25328 - protein, 453 aa, Homo sapiens
  Payload ID: 5010
  Gene Symbol: DNAJC3
  Gene Name: DnaJ (Hsp40) homolog, subfamily C, member 3
  ENSP ID: ENSP00000365991
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 25329 - protein, 504 aa, Homo sapiens
  Payload ID: 5010
  Gene Symbol: DNAJC3
  Gene Name: DnaJ (Hsp40) homolog, subfamily C, member 3
  Uniprot ID: Q13217
  ENSP ID: ENSP00000473631
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 25330 - protein, 226 aa, Homo sapiens
  Payload ID: 5011
  Gene Symbol: DNAJC30
  Gene Name: DnaJ (Hsp40) homolog, subfamily C, member 30
  Uniprot ID: Q96LL9
  ENSP ID: ENSP00000378605
MAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 25331 - protein, 249 aa, Homo sapiens
  Payload ID: 5012
  Gene Symbol: DNAJC4
  Gene Name: DnaJ (Hsp40) homolog, subfamily C, member 4
  ENSP ID: ENSP00000320548
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSSWTPPNAQYWSQFHSVRPQGPQLRQQQHKQNKQVLGYCLLLMLAGMGLHYIAFRKVKQMHLNFMDEKDRIITAFYNEARARARSVPALFCSLLPVQEPHFGIPIPTTQVPSPPGPTEASFSRSDNG

SEQ ID NO: 25332 - protein, 67 aa, Homo sapiens
  Payload ID: 5012
  Gene Symbol: DNAJC4
  Gene Name: DnaJ (Hsp40) homolog, subfamily C, member 4
  ENSP ID: ENSP00000347145
MPPLLPLRLCRLWPRNPPSRLLGAAAGQRSRPSTYYELLGVHPGASTEEVKRAFFSKSKEEGEADAP

SEQ ID NO: 25333 - protein, 241 aa, Homo sapiens
  Payload ID: 5012
  Gene Symbol: DNAJC4
  Gene Name: DnaJ (Hsp40) homolog, subfamily C, member 4
  Uniprot ID: Q9NNZ3
  ENSP ID: ENSP00000396896
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 25334 - protein, 167 aa, Homo sapiens
  Payload ID: 5012
  Gene Symbol: DNAJC4
  Gene Name: DnaJ (Hsp40) homolog, subfamily C, member 4
  ENSP ID: ENSP00000444879
  MOD_RES (1)..(1): Any amino acid
XNCWGCILVPALRKLNELSSPSPKSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPT

SEQ ID NO: 25335 - protein, 47 aa, Homo sapiens
  Payload ID: 5012
  Gene Symbol: DNAJC4
  Gene Name: DnaJ (Hsp40) homolog, subfamily C, member 4
  ENSP ID: ENSP00000445233
MPPLLPLRLCRLWPRNPPSRLLGAAAGQRRLPGLSQVTLAFPAEDQR

SEQ ID NO: 25336 - protein, 67 aa, Homo sapiens; identical to SEQ ID NO: 25332
  Payload ID: 5012
  Gene Symbol: DNAJC4
  Gene Name: DnaJ (Hsp40) homolog, subfamily C, member 4
  ENSP ID: ENSP00000486499

SEQ ID NO: 25337 - protein, 198 aa, Homo sapiens
  Payload ID: 5013
  Gene Symbol: DNAJC5
  Gene Name: DnaJ (Hsp40) homolog, subfamily C, member 5
  Uniprot ID: Q9H3Z4
  ENSP ID: ENSP00000354111
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 25338 - protein, 167 aa, Homo sapiens
  Payload ID: 5013
  Gene Symbol: DNAJC5
  Gene Name: DnaJ (Hsp40) homolog, subfamily C, member 5
  Uniprot ID: Q9H3Z4
  ENSP ID: ENSP00000434744
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDERGGH

SEQ ID NO: 25339 - protein, 199 aa, Homo sapiens
  Payload ID: 5014
  Gene Symbol: DNAJC5B
  Gene Name: DnaJ (Hsp40) homolog, subfamily C, member 5 beta
  Uniprot ID: Q9UF47
  ENSP ID: ENSP00000276570
MACNIPNQRQRTLSTTGEALYEILGLHKGASNEEIKKTYRKLALKHHPDKNPDDPAATEKFKEINNAHAILTDISKRSIYDKYGSLGLYVAEQFGDENVNTYFMLSSWWAKALFVIVGLLTGCYFCCCLCCCCNCCCGHCRPESSVPEEDFYVSPEDLEEQIKSDMEKDVDFPVFLQPTNANEKTQLIKEGSRSYCTDS

SEQ ID NO: 25340 - protein, 96 aa, Homo sapiens
  Payload ID: 5014
  Gene Symbol: DNAJC5B
  Gene Name: DnaJ (Hsp40) homolog, subfamily C, member 5 beta
  ENSP ID: ENSP00000430196
MACNIPNQRQRTLSTTGEALYEILGLHKGASNEEIKKTYRKLALKHHPDKNPDDPAATEKFKEINNAHAILTDISKRSIYDKYGSLGLYVAEQFGD

SEQ ID NO: 25341 - protein, 189 aa, Homo sapiens
  Payload ID: 5015
  Gene Symbol: DNAJC5G
  Gene Name: DnaJ (Hsp40) homolog, subfamily C, member 5 gamma
  Uniprot ID: Q8N7S2
  ENSP ID: ENSP00000296097
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 25342 - protein, 189 aa, Homo sapiens; identical to SEQ ID NO: 25341
  Payload ID: 5015
  Gene Symbol: DNAJC5G
  Gene Name: DnaJ (Hsp40) homolog, subfamily C, member 5 gamma
  Uniprot ID: Q8N7S2
  ENSP ID: ENSP00000384305

SEQ ID NO: 25343 - protein, 104 aa, Homo sapiens
  Payload ID: 5015
  Gene Symbol: DNAJC5G
  Gene Name: DnaJ (Hsp40) homolog, subfamily C, member 5 gamma
  Uniprot ID: Q8N7S2
  ENSP ID: ENSP00000385533
MSTVKEAAHRLSKSEMSLYAVLDLKKGASPEDFKKSYRHLSSCVLCSLVAVSVVAAVFAVEHLNHHLSRIVGENISRMSRVSLQGQEPNVILEARKIAKMIFKR

SEQ ID NO: 25344 - protein, 173 aa, Homo sapiens
  Payload ID: 5015
  Gene Symbol: DNAJC5G
  Gene Name: DnaJ (Hsp40) homolog, subfamily C, member 5 gamma
  ENSP ID: ENSP00000385829
MSTVKEAAHRLSKSEMSLYAVLDLKKGASPEDFKKSYRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 25345 - protein, 62 aa, Homo sapiens
  Payload ID: 5015
  Gene Symbol: DNAJC5G
  Gene Name: DnaJ (Hsp40) homolog, subfamily C, member 5 gamma
  ENSP ID: ENSP00000400382
MSTVKEAAHRLSKSEMSLYAVLDLKKGASPEDFKKSYRHLSSCVLCSLVAVSVVAAVFAVEH

SEQ ID NO: 25346 - protein, 900 aa, Homo sapiens
  Payload ID: 5016
  Gene Symbol: DNAJC6
  Gene Name: DnaJ (Hsp40) homolog, subfamily C, member 6
  Uniprot ID: O75061
  ENSP ID: ENSP00000263441
MEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 25347 - protein, 970 aa, Homo sapiens
  Payload ID: 5016
  Gene Symbol: DNAJC6
  Gene Name: DnaJ (Hsp40) homolog, subfamily C, member 6
  Uniprot ID: O75061
  ENSP ID: ENSP00000360108
MSLLGSYRKKTSNDGYESLQLVDSNGDLSAGSGGVGGKQRVNAGAAARSPARQPPDRASTMDSSGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 25348 - protein, 913 aa, Homo sapiens
  Payload ID: 5016
  Gene Symbol: DNAJC6
  Gene Name: DnaJ (Hsp40) homolog, subfamily C, member 6
  Uniprot ID: O75061
  ENSP ID: ENSP00000378735
MKDSENKGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 25349 - protein, 516 aa, Homo sapiens
  Payload ID: 5016
  Gene Symbol: DNAJC6
  Gene Name: DnaJ (Hsp40) homolog, subfamily C, member 6
  ENSP ID: ENSP00000473821
MGATEKGGQKSRKLFSLRRPWKATRRLWRPRSARQAAQGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQ

SEQ ID NO: 25350 - protein, 438 aa, Homo sapiens
  Payload ID: 5017
  Gene Symbol: DNAJC7
  Gene Name: DnaJ (Hsp40) homolog, subfamily C, member 7
  Uniprot ID: Q99615
  ENSP ID: ENSP00000313311
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 25351 - protein, 438 aa, Homo sapiens; identical to SEQ ID NO: 25350
  Payload ID: 5017
  Gene Symbol: DNAJC7
  Gene Name: DnaJ (Hsp40) homolog, subfamily C, member 7
  Uniprot ID: Q99615
  ENSP ID: ENSP00000394327

SEQ ID NO: 25352 - protein, 494 aa, Homo sapiens
  Payload ID: 5017
  Gene Symbol: DNAJC7
  Gene Name: DnaJ (Hsp40) homolog, subfamily C, member 7
  Uniprot ID: Q99615
  ENSP ID: ENSP00000406463
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 25353 - protein, 261 aa, Homo sapiens
  Payload ID: 5017
  Gene Symbol: DNAJC7
  Gene Name: DnaJ (Hsp40) homolog, subfamily C, member 7
  ENSP ID: ENSP00000464756
MSIGTCCFPGTNREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKL

SEQ ID NO: 25354 - protein, 89 aa, Homo sapiens
  Payload ID: 5017
  Gene Symbol: DNAJC7
  Gene Name: DnaJ (Hsp40) homolog, subfamily C, member 7
  ENSP ID: ENSP00000464993
  MOD_RES (1)..(1): Any amino acid
XKEDGNKAFKEGNYKLAYELYTEALGIDPNNIKTNAKLYCNRGTVNSKLRKLDDAIEDCTNAVKLDDTYIKAYLRRAQWWDCSSPRLSL

SEQ ID NO: 25355 - protein, 74 aa, Homo sapiens
  Payload ID: 5017
  Gene Symbol: DNAJC7
  Gene Name: DnaJ (Hsp40) homolog, subfamily C, member 7
  ENSP ID: ENSP00000465140
MCPKNASYYGNRAATLMMLGRFREALGDAQQSVRLDDSFVRGHLREGKCHLSLGNAMAACRSFQRALELDHKNA

SEQ ID NO: 25356 - protein, 102 aa, Homo sapiens
  Payload ID: 5017
  Gene Symbol: DNAJC7
  Gene Name: DnaJ (Hsp40) homolog, subfamily C, member 7
  ENSP ID: ENSP00000465228
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDF

SEQ ID NO: 25357 - protein, 113 aa, Homo sapiens
  Payload ID: 5017
  Gene Symbol: DNAJC7
  Gene Name: DnaJ (Hsp40) homolog, subfamily C, member 7
  ENSP ID: ENSP00000465340
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRAL

SEQ ID NO: 25358 - protein, 75 aa, Homo sapiens
  Payload ID: 5017
  Gene Symbol: DNAJC7
  Gene Name: DnaJ (Hsp40) homolog, subfamily C, member 7
  ENSP ID: ENSP00000465399
MCPKNASYYGNRAATLMMLGRFREALGDAQQSVRLDDSFVRGHLREGKCHLSLGNAMAACRSFQRALELDHKNAQ

SEQ ID NO: 25359 - protein, 137 aa, Homo sapiens
  Payload ID: 5017
  Gene Symbol: DNAJC7
  Gene Name: DnaJ (Hsp40) homolog, subfamily C, member 7
  ENSP ID: ENSP00000466114
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQELH

SEQ ID NO: 25360 - protein, 104 aa, Homo sapiens
  Payload ID: 5017
  Gene Symbol: DNAJC7
  Gene Name: DnaJ (Hsp40) homolog, subfamily C, member 7
  ENSP ID: ENSP00000466748
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRK

SEQ ID NO: 25361 - protein, 39 aa, Homo sapiens
  Payload ID: 5017
  Gene Symbol: DNAJC7
  Gene Name: DnaJ (Hsp40) homolog, subfamily C, member 7
  ENSP ID: ENSP00000466877
MAAAAECDVVMAATEPELLDDQEAKSPTPLTSHPSVPLL

SEQ ID NO: 25362 - protein, 253 aa, Homo sapiens
  Payload ID: 5017
  Gene Symbol: DNAJC7
  Gene Name: DnaJ (Hsp40) homolog, subfamily C, member 7
  ENSP ID: ENSP00000467477
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKETR

SEQ ID NO: 25363 - protein, 55 aa, Homo sapiens
  Payload ID: 5017
  Gene Symbol: DNAJC7
  Gene Name: DnaJ (Hsp40) homolog, subfamily C, member 7
  ENSP ID: ENSP00000467702
DKNASEDEIKKAYRKRALMHHPDFDPNNIFKAFFGGPGGFSFEASGPGNFFFQFG

SEQ ID NO: 25364 - protein, 128 aa, Homo sapiens
  Payload ID: 5017
  Gene Symbol: DNAJC7
  Gene Name: DnaJ (Hsp40) homolog, subfamily C, member 7
  ENSP ID: ENSP00000468102
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAE

SEQ ID NO: 25365 - protein, 258 aa, Homo sapiens
  Payload ID: 5017
  Gene Symbol: DNAJC7
  Gene Name: DnaJ (Hsp40) homolog, subfamily C, member 7
  ENSP ID: ENSP00000468805
MAAAAECDVVMAATEPELLDDQEAKREAETFKEQGNAYYAKKDYNEAYNYYTKAIDMCPKNASYYGNRAATLMMLGRFREALGDAQQSVRLDDSFVRFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKL

SEQ ID NO: 25366 - protein, 253 aa, Homo sapiens
  Payload ID: 5018
  Gene Symbol: DNAJC8
  Gene Name: DnaJ (Hsp40) homolog, subfamily C, member 8
  Uniprot ID: O75937
  ENSP ID: ENSP00000263697
MAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQRE

SEQ ID NO: 25367 - protein, 106 aa, Homo sapiens
  Payload ID: 5018
  Gene Symbol: DNAJC8
  Gene Name: DnaJ (Hsp40) homolog, subfamily C, member 8
  ENSP ID: ENSP00000474440
  MOD_RES (1)..(1): Any amino acid
XFKQAVYKQTMKLFAELEIKRKEREAKEMHERKRQREEEIEAQEKAKREREWQKNFEESRDGRVDSWRNFQANTKGKKEKKNRTFLRPPKVKMEQRTESALRRGPK

SEQ ID NO: 25368 - protein, 260 aa, Homo sapiens
  Payload ID: 5019
  Gene Symbol: DNAJC9
  Gene Name: DnaJ (Hsp40) homolog, subfamily C, member 9
  Uniprot ID: Q8WXX5
  ENSP ID: ENSP00000362041
MGLLDLCEEVFGTADLYRVLGVRREASDGEVRRGYHKVSLQVHPDRVGEGDKEDATRRFQILGKVYSVLSDREQRAVYDEQGTVDEDSPVLTQDRDWEAYWRLLFKKISLEDIQAFEKTYKGSEEELADIKQAYLDFKGDMDQIMESVLCVQYTEEPRIRNIIQQAIDAGEVPSYNAFVKESKQKMNARKRRAQEEAKEAEMSRKELGLDEGVDSLKAAIQSRQKDRQKEMDNFLAQMEAKYCKSSKGGGKKSALKKEKK

SEQ ID NO: 25369 - protein, 153 aa, Homo sapiens
  Payload ID: 5020
  Gene Symbol: DNAJC25-GNG10
  Gene Name: DNAJC25-GNG10 readthrough
  ENSP ID: ENSP00000363412
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 25370 - protein, 353 aa, Homo sapiens
  Payload ID: 5021
  Gene Symbol: DND1
  Gene Name: DND microRNA-mediated repression inhibitor 1
  Uniprot ID: Q8IYX4
  ENSP ID: ENSP00000445366
MQSKRDCELWCERVNPENKAALEAWVRETGIRLVQVNGQRKYGGPPPGWVGSPPPAGSEVFIGRLPQDVYEHQLIPLFQRVGRLYEFRLMMTFSGLNRGFAYARYSSRRGAQAAIATLHNHPLRPSCPLLVCRSTEKCELSVDGLPPNLTRSALLLALQPLGPGLQEARLLPSPGPAPGQIALLKFSSHRAAAMAKKALVEGQSHLCGEQVAVEWLKPDLKQRLRQQLVGPFLRSPQPEGSQLALARDKLGFQGARATLQLLCQRMKLGSPVFLTKCLGIGPAGWHRFWYQVVIPGHPVPFSGLIWVVLTLDGRDGHEVAKDAVSVRLLQALSESGANLLWSAGAEAGTMVKQ

SEQ ID NO: 25371 - protein, 178 aa, Homo sapiens
  Payload ID: 5022
  Gene Symbol: DNLZ
  Gene Name: DNL-type zinc finger
  Uniprot ID: Q5SXM8
  ENSP ID: ENSP00000360803
MLRTALRGAPRLLSRVQPRAPCLRRLWGRGARPEVAGRRRAWAWGWRRSSSEQGPGPAAALGRVEAAHYQLVYTCKVCGTRSSKRISKLAYHQGVVIVTCPGCQNHHIIADNLGWFSDLNGKRNIEEILTARGEQVHRVAGEGALELVLEAAGAPTSTAAPEAGEDEGPPSPGKTEPS

SEQ ID NO: 25372 - protein, 117 aa, Homo sapiens
  Payload ID: 5022
  Gene Symbol: DNLZ
  Gene Name: DNL-type zinc finger
  ENSP ID: ENSP00000360804
MLRTALRGAPRLLSRVQPRAPCLRRLWGRGARPEVAGRRRAWAWGWRRSSSEQGPGPAAALGRVEAAHYQLVYTCKKYRRDPDGQRRAGAPCGGRGGPGTGSGGCRGPHIHCSSGSG

SEQ ID NO: 25373 - protein, 481 aa, Homo sapiens [sequence omitted]

SEQ ID NO: 25374 - protein, 177 aa, Homo sapiens
  Payload ID: 5023
  Gene Symbol: DOK1
  Gene Name: docking protein 1, 62kDa (downstream of tyrosine kinase 1)
  Uniprot ID: Q99704
  ENSP ID: ENSP00000344330
MDGAVMEGPLFLQSQRFGTKRWRKTWAVLYPASPHGVARLEFFDHKGSSSGGGRGSSRRLDCKVIRLAECVSVAPVTVETPPEPGATAFRLDTAQRSHLLAADAPSSAAWVQTLCRNAFPKGSWTLAPTDNPPKLSALEMLENSLYSPTWEGHVLFRGRPPLPLRPWNLHLPDGTGK

SEQ ID NO: 25375 - protein, 342 aa, Homo sapiens
  Payload ID: 5023
  Gene Symbol: DOK1
  Gene Name: docking protein 1, 62kDa (downstream of tyrosine kinase 1)
  Uniprot ID: Q99704
  ENSP ID: ENSP00000387016
MLENSLYSPTWEGSQFWVTVQRTEAAERCGLHGSYVLRVEAERLTLLTVGAQSQILEPLLSWPYTLLRRYGRDKVMFSFEAGRRCPSGPGTFTFQTAQGNDIFQAVETAIHRQKAQGKAGQGHDVLRADSHEGEVAEGKLPSPPGPQELLDSPPALYAEPLDSLRIAPCPSQDSLYSDPLDSTSAQAGEGVQRKKPLYWDLYEHAQQQLLKAKLTDPKEDPIYDEPEGLAPVPPQGLYDLPREPKDAWWCQARVKEEGYELPYNPATDDYAVPPPRSTKPLLAPKPQGPAFPEPGTATGSGIKSHNSALYSQVQKSGASGSWDCGLSRVGTDKTGVKSEGST

SEQ ID NO: 25376 - protein, 88 aa, Homo sapiens
  Payload ID: 5023
  Gene Symbol: DOK1
  Gene Name: docking protein 1, 62kDa (downstream of tyrosine kinase 1)
  ENSP ID: ENSP00000393586
  MOD_RES (1)..(1): Any amino acid
XRLEFFDHKGSSSGGGRGSSRRLDCKVIRLAECVSVAPVTVETPPEPGATAFRLDTAQRSHLLAADAPSSAAWVQTLCRNAFPDPNSG

SEQ ID NO: 25377 - protein, 412 aa, Homo sapiens
  Payload ID: 5024
  Gene Symbol: DOK2
  Gene Name: docking protein 2, 56kDa
  Uniprot ID: O60496
  ENSP ID: ENSP00000276420
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRGILAVPPQLLADPLYDSIEETLPPRPDHIYDEPEGVAALSLYDSPQEPRGEAWRRQATADRDPAGLQHVQPAGQDFSASGWQPGTEYDNVVLKKGPK

SEQ ID NO: 25378 - protein, 233 aa, Homo sapiens
  Payload ID: 5024
  Gene Symbol: DOK2
  Gene Name: docking protein 2, 56kDa
  ENSP ID: ENSP00000429224
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKAVAASLERATLSSKPGKAMRSSWPWKR

SEQ ID NO: 25379 - protein, 123 aa, Homo sapiens
  Payload ID: 5024
  Gene Symbol: DOK2
  Gene Name: docking protein 2, 56kDa
  ENSP ID: ENSP00000429508
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPSAPTRNLL

SEQ ID NO: 25380 - protein, 151 aa, Homo sapiens
  Payload ID: 5024
  Gene Symbol: DOK2
  Gene Name: docking protein 2, 56kDa
  ENSP ID: ENSP00000430729
MRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDA

SEQ ID NO: 25381 - protein, 330 aa, Homo sapiens
  Payload ID: 5025
  Gene Symbol: DOK3
  Gene Name: docking protein 3
  Uniprot ID: Q7L591
  ENSP ID: ENSP00000325174
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLLCSCSWRHPRSQPRTQASCLQGSDCPAPHRNSTSAAHTLGTS

SEQ ID NO: 25382 - protein, 496 aa, Homo sapiens
  Payload ID: 5025
  Gene Symbol: DOK3
  Gene Name: docking protein 3
  Uniprot ID: Q7L591
  ENSP ID: ENSP00000349727
MTRGARLRSDARAQLNQLSLDGGTGSGQKGKCEEFPSSLSSVSPGLEAAALLLAVTMDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 25383 - protein, 228 aa, Homo sapiens
  Payload ID: 5025
  Gene Symbol: DOK3
  Gene Name: docking protein 3
  Uniprot ID: Q7L591
  ENSP ID: ENSP00000366316
MDPLETPIKDGILYQQHVKFGKGTGEASSGSTDAQSPKRGLVPMEENSIYSSWQEVGEFPVVVQRTEAATRCQLKGPALLVLGPDAIQLREAKGTQALYSWPYHFLRKFGSDKILLGTPGVSLLICKGERTDDVSGIILDESLLRAYSVPGAGGHSRVQDSLGPVLREPTFQGERSFLKTSMLRSLLCSCSWRHPRSQPRTQASCLQGSDCPAPHRNSTSAAHTLGTS

SEQ ID NO: 25384 - protein, 440 aa, Homo sapiens
  Payload ID: 5025
  Gene Symbol: DOK3
  Gene Name: docking protein 3
  ENSP ID: ENSP00000421688
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGSDKGVFSFEAGRRCHSGEGLFAFSTPCAPDLCRAVAGAIARQRERLPELTRPQPCPLPRATSLPSLDTPGELREMPPGPEPPTSRKMHLAEPGPQSLPLLLGPEPNDLASGLYASVCKRASGPPGNEHLYENLCVLEASPTLHGGEPEPHEGPGSRSPTTSPIYHNGQDLSWPGPANDSTLEAQYRRLLELDQVEGTGRPDPQAGFKAKLVTLLSRERRKGPAPCDRP

SEQ ID NO: 25385 - protein, 213 aa, Homo sapiens
  Payload ID: 5025
  Gene Symbol: DOK3
  Gene Name: docking protein 3
  ENSP ID: ENSP00000422395
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQALYSWPYHFLRKFGS

SEQ ID NO: 25386 - protein, 156 aa, Homo sapiens
  Payload ID: 5025
  Gene Symbol: DOK3
  Gene Name: docking protein 3
  ENSP ID: ENSP00000423328
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQ

SEQ ID NO: 25387 - protein, 144 aa, Homo sapiens
  Payload ID: 5025
  Gene Symbol: DOK3
  Gene Name: docking protein 3
  ENSP ID: ENSP00000423635
MDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLV

SEQ ID NO: 25388 - protein, 43 aa, Homo sapiens
  Payload ID: 5025
  Gene Symbol: DOK3
  Gene Name: docking protein 3
  ENSP ID: ENSP00000424580
MDPLETPIKDGILYQQHVKFGKKCWRKVWALLYAGGPSGVARL

SEQ ID NO: 25389 - protein, 85 aa, Homo sapiens
  Payload ID: 5025
  Gene Symbol: DOK3
  Gene Name: docking protein 3
  ENSP ID: ENSP00000424726
MDPLETPIKDGILYQQHVKFGKKCWRKVWALLYAGGPSGVARLESWEVRDGGLGAAGDRSAGPGRRGERRVIRLADCVSVLPADG

SEQ ID NO: 25390 - protein, 13 aa, Homo sapiens
  Payload ID: 5025
  Gene Symbol: DOK3
  Gene Name: docking protein 3
  ENSP ID: ENSP00000426694
MDPLETPIKDGIL

SEQ ID NO: 25391 - protein, 326 aa, Homo sapiens
  Payload ID: 5026
  Gene Symbol: DOK4
  Gene Name: docking protein 4
  Uniprot ID: Q8TEW6
  ENSP ID: ENSP00000344277
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGEGYGAAQASSETDLLNRFILLKPKPSQGDSSEAKTPSQ

SEQ ID NO: 25392 - protein, 78 aa, Homo sapiens
  Payload ID: 5026
  Gene Symbol: DOK4
  Gene Name: docking protein 4
  ENSP ID: ENSP00000454738
MATNFSDIVKQGYVKMKSRKLGIYRRCWLVFRKSSSKGPQRLEKYPDEKSVCLRGCPKVTEISNVKCVTRLPKETKRQ

SEQ ID NO: 25393 - protein, 326 aa, Homo sapiens; identical to SEQ ID NO: 25391
  Payload ID: 5026
  Gene Symbol: DOK4
  Gene Name: docking protein 4
  Uniprot ID: Q8TEW6
  ENSP ID: ENSP00000455128

SEQ ID NO: 25394 - protein, 53 aa, Homo sapiens
  Payload ID: 5026
  Gene Symbol: DOK4
  Gene Name: docking protein 4
  ENSP ID: ENSP00000455528
MATNFSDIVKQGYVKMKSRKLGIYRRCWLVFRKSSSKGPQRLEKYPDEKSVCL

SEQ ID NO: 25395 - protein, 365 aa, Homo sapiens
  Payload ID: 5026
  Gene Symbol: DOK4
  Gene Name: docking protein 4
  ENSP ID: ENSP00000455566
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVRLLNKGTEHYSYPCTPTTMLPRSAYWHHITGSQNIAEASSYAGESLPCPTPTCQEALWRMRPIGQGSFDLALSSEPASVPTGEGYGAAQASSETDLLNRFILLKPKPSQGDSSEAKTPSQ

SEQ ID NO: 25396 - protein, 122 aa, Homo sapiens
  Payload ID: 5026
  Gene Symbol: DOK4
  Gene Name: docking protein 4
  ENSP ID: ENSP00000456590
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLG

SEQ ID NO: 25397 - protein, 100 aa, Homo sapiens
  Payload ID: 5026
  Gene Symbol: DOK4
  Gene Name: docking protein 4
  ENSP ID: ENSP00000456739
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEA

SEQ ID NO: 25398 - protein, 59 aa, Homo sapiens
  Payload ID: 5026
  Gene Symbol: DOK4
  Gene Name: docking protein 4
  ENSP ID: ENSP00000456864
MATNFSDIVKQGYVKMKSRKLGIYRRCWLVFRKSSSKGPQRLEKYPDEKSVCLRGCPKS

SEQ ID NO: 25399 - protein, 77 aa, Homo sapiens
  Payload ID: 5026
  Gene Symbol: DOK4
  Gene Name: docking protein 4
  ENSP ID: ENSP00000457188
MATNFSDIVKQGYVKMKSRKLGIYRRCWLVFRKSSSKGPQRLEKYPDEKSVCLRGCPKVTEISNVKCVTRLPKETKR

SEQ ID NO: 25400 - protein, 113 aa, Homo sapiens
  Payload ID: 5026
  Gene Symbol: DOK4
  Gene Name: docking protein 4
  ENSP ID: ENSP00000457192
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLG

SEQ ID NO: 25401 - protein, 103 aa, Homo sapiens
  Payload ID: 5026
  Gene Symbol: DOK4
  Gene Name: docking protein 4
  ENSP ID: ENSP00000457212
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEW

SEQ ID NO: 25402 - protein, 115 aa, Homo sapiens
  Payload ID: 5026
  Gene Symbol: DOK4
  Gene Name: docking protein 4
  ENSP ID: ENSP00000457621
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSR

SEQ ID NO: 25403 - protein, 113 aa, Homo sapiens; identical to SEQ ID NO: 25400
  Payload ID: 5026
  Gene Symbol: DOK4
  Gene Name: docking protein 4
  ENSP ID: ENSP00000457670

SEQ ID NO: 25404 - protein, 113 aa, Homo sapiens; identical to SEQ ID NO: 25400
  Payload ID: 5026
  Gene Symbol: DOK4
  Gene Name: docking protein 4
  ENSP ID: ENSP00000457730

SEQ ID NO: 25405 - protein, 246 aa, Homo sapiens
  Payload ID: 5026
  Gene Symbol: DOK4
  Gene Name: docking protein 4
  ENSP ID: ENSP00000457971
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRLNDISLGEPDLLAPGVQCEQTDRFNVFLLPCPNLDVYGECKLQITHENIYLWDIHNPRVKLVSWPLCSLRRYGRDATRFTFEAGRMCDAGEGLYTFQTQEGEQIYQRVHSATLAIAEQHKRVLLEMEKNVR

SEQ ID NO: 25406 - protein, 116 aa, Homo sapiens
  Payload ID: 5026
  Gene Symbol: DOK4
  Gene Name: docking protein 4
  ENSP ID: ENSP00000458037
MATNFSDIVKQGYVKMKSRKLGIYRRCWLVFRKSSSKGPQRLEKYPDEKSVCLRGCPKVTEISNVKCVTRLPKETKRQAVAIIFTDDSARTFTCDSELEAEEWYKTLSVECLGSRL

SEQ ID NO: 25407 - protein, 306 aa, Homo sapiens [sequence omitted]

SEQ ID NO: 25408 - protein, 198 aa, Homo sapiens
  Payload ID: 5027
  Gene Symbol: DOK5
  Gene Name: docking protein 5
  Uniprot ID: Q9P104
  ENSP ID: ENSP00000379270
MECVGTRINDISLGEPDLLATGVEREQSERFNVYLMPSPNLDVHGECALQITYEYICLWDVQNPRVKLISWPLSALRRYGRDTTWFTFEAGRMCETGEGLFIFQTRDGEAIYQKVHSAALAIAEQHERLLQSVKNSMLQMKMSERAASLSTMVPLPRSAYWQHITRQHSTGQLYRLQDVSSPLKLHRTETFPAYRSEH

SEQ ID NO: 25409 - protein, 331 aa, Homo sapiens
  Payload ID: 5028
  Gene Symbol: DOK6
  Gene Name: docking protein 6
  Uniprot ID: Q6PKX4
  ENSP ID: ENSP00000372160
MASNFNDIVKQGYVKIRSRKLGIFRRCWLVFKKASSKGPRRLEKFPDEKAAYFRNFHKVTELHNIKNITRLPRETKKHAVAIIFHDETSKTFACESELEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGHGFGSSKMSRAQTFPSYAPEQSEEAQQPLSRSSSYGFSYSSSLIQ

SEQ ID NO: 25410 - protein, 156 aa, Homo sapiens
  Payload ID: 5028
  Gene Symbol: DOK6
  Gene Name: docking protein 6
  ENSP ID: ENSP00000462984
  MOD_RES (1)..(1): Any amino acid
XLEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARVRPLPW

SEQ ID NO: 25411 - protein, 504 aa, Homo sapiens
  Payload ID: 5029
  Gene Symbol: DOK7
  Gene Name: docking protein 7
  Uniprot ID: Q18PE1
  ENSP ID: ENSP00000344432
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRCGYWAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKVNPPP

SEQ ID NO: 25412 - protein, 255 aa, Homo sapiens
  Payload ID: 5029
  Gene Symbol: DOK7
  Gene Name: docking protein 7
  Uniprot ID: Q18PE1
  ENSP ID: ENSP00000423614
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRGWRLLPVLGRGGADQLPVRLHRPRHLPHQGPLWAAAGSTRPKSPGTLDCGGACGPGSPGNPTAGEAAEPPLTCGQAGQWRG

SEQ ID NO: 25413 - protein, 538 aa, Homo sapiens
  Payload ID: 5030
  Gene Symbol: DOLK
  Gene Name: dolichol kinase
  Uniprot ID: Q9UPQ8
  ENSP ID: ENSP00000361667
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTWASSIFFHLMTCVLSLGVVLPWLHRLIRRNPLLWLLQFLFQTDTRIYLLAYWSLLATLACLVVLYQNAKRSSSESKKHQAPTIARKYFHLIVVATYIPGIIFDRPLLYVAATVCLAVFIFLEYVRYFRIKPLGHTLRSFLSLFLDERDSGPLILTHIYLLLGMSLPIWLIPRPCTQKGSLGGARALVPYAGVLAVGVGDTVASIFGSTMGEIRWPGTKKTFEGTMTSIFAQIISVALILIFDSGVDLNYSYAWILGSISTVSLLEAYTTQIDNLLLPLYLLILLMA

SEQ ID NO: 25414 - protein, 91 aa, Homo sapiens
  Payload ID: 5031
  Gene Symbol: DOLPP1
  Gene Name: dolichyldiphosphatase 1
  ENSP ID: ENSP00000333294
  MOD_RES (1)..(1): Any amino acid
XAADGQCSLPASWRPVTLTHVEYPAGDLSGHLLAYLSLSPVFVIVGFVTLIIFKRELHTAPTQQWAPSTGCPPAIPSLCGSSPSIPSFSCI

SEQ ID NO: 25415 - protein, 238 aa, Homo sapiens
  Payload ID: 5031
  Gene Symbol: DOLPP1
  Gene Name: dolichyldiphosphatase 1
  Uniprot ID: Q86YN1
  ENSP ID: ENSP00000361625
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRVYLLYHTWSQVLYGGIAGGLMAIAWFIFTQEVLTPLFPRIAAWPVSEFFLIRDTSLIPNVLWFEYTVTRAEARNRQRKLGTKLQ

SEQ ID NO: 25416 - protein, 195 aa, Homo sapiens
  Payload ID: 5031
  Gene Symbol: DOLPP1
  Gene Name: dolichyldiphosphatase 1
  Uniprot ID: Q86YN1
  ENSP ID: ENSP00000384043
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRPVSEFFLIRDTSLIPNVLWFEYTVTRAEARNRQRKLGTKLQ

SEQ ID NO: 25417 - protein, 89 aa, Homo sapiens
  Payload ID: 5031
  Gene Symbol: DOLPP1
  Gene Name: dolichyldiphosphatase 1
  ENSP ID: ENSP00000403278
  MOD_RES (1)..(1): Any amino acid
XDGQCSLPASWRPVTLTHVEYPAGDLSGHLLAYLSLSPVFVIVGFVTLIIFKRELHTAPTQQWAPSTGCPPAIPSLCGSSPSIPSFSCI

SEQ ID NO: 25418 - protein, 456 aa, Homo sapiens
  Payload ID: 5032
  Gene Symbol: DDOST
  Gene Name: dolichyl-diphosphooligosaccharide--protein glycosyltransferase subunit (non-catalytic)
  Uniprot ID: P39656
  ENSP ID: ENSP00000364188
MGYFRCARAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 25419 - protein, 456 aa, Homo sapiens; identical to SEQ ID NO: 25418
  Payload ID: 5032
  Gene Symbol: DDOST
  Gene Name: dolichyl-diphosphooligosaccharide--protein glycosyltransferase subunit (non-catalytic)
  Uniprot ID: P39656
  ENSP ID: ENSP00000399457

SEQ ID NO: 25420 - protein, 439 aa, Homo sapiens
  Payload ID: 5032
  Gene Symbol: DDOST
  Gene Name: dolichyl-diphosphooligosaccharide--protein glycosyltransferase subunit (non-catalytic)
  ENSP ID: ENSP00000473655
MEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 25421 - protein, 154 aa, Homo sapiens
  Payload ID: 5032
  Gene Symbol: DDOST
  Gene Name: dolichyl-diphosphooligosaccharide--protein glycosyltransferase subunit (non-catalytic)
  ENSP ID: ENSP00000475634
MEPSTAARAWALFWLLLPLLGAVCASGPRTLVLLDNLNVRETHSLFFRSLKDRGFELTFKTADDPSLSLIKYGEFLYDNLIIFSPSVEGDPLRELGSECGIEFDEEKTAVIDHHNYDISDLGQHTLIVADTENLLKAPTIVGKSSLNPILFRGV

SEQ ID NO: 25422 - protein, 408 aa, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  Uniprot ID: Q9H3H5
  ENSP ID: ENSP00000346142
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 25423 - protein, 57 aa, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENSP ID: ENSP00000376579
MWAFSELPMPLLINLIVSLLGFVATVTLIPAFRGHFIAARLCGQDLNKTSRQQILWP

SEQ ID NO: 25424 - protein, 408 aa, Homo sapiens; identical to SEQ ID NO: 25422
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  Uniprot ID: Q9H3H5
  ENSP ID: ENSP00000386597

SEQ ID NO: 25425 - protein, 95 aa, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENSP ID: ENSP00000402019
MWAFSELPMPLLINLIVSLLGFVATVTLIPAFRGHFIAARLCGQDLNKTSRQQIPESQGVISGAVFLIILFCFIPFPFLNCFVKEQCKAFPHHEA

SEQ ID NO: 25426 - protein, 226 aa, Homo sapiens
  Payload ID: 5033
  Gene Symbol: DPAGT1
  Gene Name: dolichyl-phosphate (UDP-N-acetylglucosamine) N-acetylglucosaminephosphotransferase 1 (GlcNAc-1-P transferase)
  ENSP ID: ENSP00000406591
ASDYVGNRFPARNRRVSTPSSLLPTPCLSIAIFLEPEASQIKGEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWCSTSSTHCLSSCISSPALATAYPDSISRQANWR

SEQ ID NO: 25427 - protein, 287 aa, Homo sapiens
  Payload ID: 5034
  Gene Symbol: DPM1
  Gene Name: dolichyl-phosphate mannosyltransferase polypeptide 1, catalytic subunit
  ENSP ID: ENSP00000360638
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISDGVLPCCPGWSLLGSSDPAILASWDYSRGANFLTQILLRPGASDLTGSFRLYRKEVLEKLIEKCVSKGYVFQMEMIVRARQLNYTIGEVPISFVDRVYGESKLGGNEIVSFLKGLLTLFATT

SEQ ID NO: 25428 - protein, 295 aa, Homo sapiens
  Payload ID: 5034
  Gene Symbol: DPM1
  Gene Name: dolichyl-phosphate mannosyltransferase polypeptide 1, catalytic subunit
  ENSP ID: ENSP00000360640
  MOD_RES (1)..(1): Any amino acid
XASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISDGVLPCCPGWSLLGSSDPAILASWDYRCEPPRLASRGANFLTQILLRPGASDLTGSFRLYRKEVLEKLIEKCVSKGYVFQMEMIVRARQLNYTIGEVPISFVDRVYGESKLGGNEIVSFLKGLLTLFATT

SEQ ID NO: 25429 - protein, 260 aa, Homo sapiens
  Payload ID: 5034
  Gene Symbol: DPM1
  Gene Name: dolichyl-phosphate mannosyltransferase polypeptide 1, catalytic subunit
  Uniprot ID: O60762
  ENSP ID: ENSP00000360644
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISRGANFLTQILLRPGASDLTGSFRLYRKEVLEKLIEKCVSKGYVFQMEMIVRARQLNYTIGEVPISFVDRVYGESKLGGNEIVSFLKGLLTLFATT

SEQ ID NO: 25430 - protein, 221 aa, Homo sapiens
  Payload ID: 5034
  Gene Symbol: DPM1
  Gene Name: dolichyl-phosphate mannosyltransferase polypeptide 1, catalytic subunit
  ENSP ID: ENSP00000394921
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFISDGVLPCCPGWSLLGSSDPAILASWDYSRGANFLTQILLRPGASDLTGSFRLYRKEVLEKLIEKCVSKGYVFQMEMIVRARQLNYTIGE

SEQ ID NO: 25431 - protein, 84 aa, Homo sapiens
  Payload ID: 5035
  Gene Symbol: DPM2
  Gene Name: dolichyl-phosphate mannosyltransferase polypeptide 2, regulatory subunit
  Uniprot ID: O94777
  ENSP ID: ENSP00000322181
MATGTDQVVGLGLVAVSLIIFTYYTAWVILLPFIDSQHVIHKYFLPRAYAVAIPLAAGLLLLLFVGLFISYVMLKTKRVTKKAQ

SEQ ID NO: 25432 - protein, 130 aa, Homo sapiens
  Payload ID: 5035
  Gene Symbol: DPM2
  Gene Name: dolichyl-phosphate mannosyltransferase polypeptide 2, regulatory subunit
  ENSP ID: ENSP00000362202
MATGTDQVVGLGLVAVSLIIFTYYTAWVILLPFIDSQHVIHKYFLPRAYAVAIPLAAGLLLLLFVGKSSPPPLDPGQGFGKTPPLNMLPHFGGAGSCLPRTHPWGFPVHPSRLPVSNLWVSWCPRLFGLQ

SEQ ID NO: 25433 - protein, 92 aa, Homo sapiens
  Payload ID: 5036
  Gene Symbol: DPM3
  Gene Name: dolichyl-phosphate mannosyltransferase polypeptide 3
  Uniprot ID: Q9P2X0
  ENSP ID: ENSP00000344338
MTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 25434 - protein, 122 aa, Homo sapiens
  Payload ID: 5036
  Gene Symbol: DPM3
  Gene Name: dolichyl-phosphate mannosyltransferase polypeptide 3
  Uniprot ID: Q9P2X0
  ENSP ID: ENSP00000357384
MLSVGGLRLSLVRFSFLLLRGALLPSLAVTMTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 25435 - protein, 92 aa, Homo sapiens; identical to SEQ ID NO: 25433
  Payload ID: 5036
  Gene Symbol: DPM3
  Gene Name: dolichyl-phosphate mannosyltransferase polypeptide 3
  Uniprot ID: Q9P2X0
  ENSP ID: ENSP00000357385

SEQ ID NO: 25436 - protein, 480 aa, Homo sapiens
  Payload ID: 5037
  Gene Symbol: DDC
  Gene Name: dopa decarboxylase (aromatic L-amino acid decarboxylase)
  Uniprot ID: P20711
  ENSP ID: ENSP00000350616
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25437 - protein, 338 aa, Homo sapiens
  Payload ID: 5037
  Gene Symbol: DDC
  Gene Name: dopa decarboxylase (aromatic L-amino acid decarboxylase)
  Uniprot ID: P20711
  ENSP ID: ENSP00000370371
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWSRQPVRMLRLKKTCLVSAVVRRS

SEQ ID NO: 25438 - protein, 361 aa, Homo sapiens
  Payload ID: 5037
  Gene Symbol: DDC
  Gene Name: dopa decarboxylase (aromatic L-amino acid decarboxylase)
  ENSP ID: ENSP00000389422
  MOD_RES (1)..(1): Any amino acid
XGYLRPLIPAAAPQEPDTFEDIINDVEKIIMPGVTHWHSPYFFAYFPTASSYPAMLADMLCGAIGCIGFSWAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25439 - protein, 229 aa, Homo sapiens
  Payload ID: 5037
  Gene Symbol: DDC
  Gene Name: dopa decarboxylase (aromatic L-amino acid decarboxylase)
  ENSP ID: ENSP00000393724
MNASEFRRRGKEMVDYMANYMEGIEGRQVYPDVEPGYLRPLIPAAAPQEPDTFEDIINDVEKIIMPGAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPIFCRFIQL

SEQ ID NO: 25440 - protein, 402 aa, Homo sapiens
  Payload ID: 5037
  Gene Symbol: DDC
  Gene Name: dopa decarboxylase (aromatic L-amino acid decarboxylase)
  Uniprot ID: P20711
  ENSP ID: ENSP00000395069
MNASEFRRRGKEMVDYMANYMEGIEGRQVYPDVEPGYLRPLIPAAAPQEPDTFEDIINDVEKIIMPGGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25441 - protein, 387 aa, Homo sapiens
  Payload ID: 5037
  Gene Symbol: DDC
  Gene Name: dopa decarboxylase (aromatic L-amino acid decarboxylase)
  Uniprot ID: P20711
  ENSP ID: ENSP00000399184
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25442 - protein, 480 aa, Homo sapiens; identical to SEQ ID NO: 25436
  Payload ID: 5037
  Gene Symbol: DDC
  Gene Name: dopa decarboxylase (aromatic L-amino acid decarboxylase)
  Uniprot ID: P20711
  ENSP ID: ENSP00000403644

SEQ ID NO: 25443 - protein, 30 aa, Homo sapiens
  Payload ID: 5037
  Gene Symbol: DDC
  Gene Name: dopa decarboxylase (aromatic L-amino acid decarboxylase)
  ENSP ID: ENSP00000408626
MNASEFRRRGKEMVDYMANYMEGIEGRQVY
